United States Patent 12,616,207 (BOXWOOD ENDOPHYTE BURKHOLDERIA SP SSG AS POTENTIAL BIOCONTROL AGENT AGAINST A WIDE RANGE OF PATHOGENS) - sequence listing, part 2

SEQ ID NO: 1 - DNA, 5470797 bp, Burkholderia cepacia strain SSG (residues 1,823,600-3,647,198 of 5,470,797)
ctcgcggggcccggcgtgccggaaggcagccgtcccgggcgtttcagccagcgcaacgcaccgtcgctgctctatgtgcgttacgtgccgcgccgccacttctatcaggacgacgacgcgcccgcaccgtcgccgttcggcggcctgttcagcgacggccgcgcggatacgctcgccgagcagatccgcgggccgctgttcgatccgaacgagatgaacaaccggtcgccggccgcgctgctgcgcaaggtggacgcaaccgaactcgcgcccgatctcgccgcgcgcttcggcgcgtcggtgcggcgcgatcccgggcaactggtgcgggcgctgggcctggccgtcgaggcctatctgcagagcgacgagatggcgccgttcacgtcgcgtttcgacgcgttcctgcgcacgcgcaagccgctcgcgccggccgagatgcgcggcctcgcgctgttccgaatccggacaagggcaactgcacgagctgccacacgctgtcggagacatcgagccgaccggagcgttcgctcttcaccgatttcggctacgacgcgatcgcggtgccgcgcaaccgcgcgctgccggcgaaccgcgatccgcggcatttcgacaacgggctgtgcgacaccgcccggcggctgcgctggcccgagccgacgcaatggtgcggctacctgcgcacaccggggctgcgcaacgtcgcgctcaagcagacgttcatgcacaacggcgtgttcacgacgctgcgcgacgcggtcgcgttctacaacacgcgctcgaccgacccgagcttctggtatcacggggccggaacgttcgacgatgtgccggccgcctatcgcggcaacatcaacgtcaactcgacgccgatgaaccgccggcccggcacgccgcccgcgctgaccgacgcggagatcgacgacatcgtcgcgttcctcggcacgctgaccgacgcgcgctatacgggggcacagcctccgcggcgcccgctgccccggtcgcccctgcggccgctgttgcccggtcacgcgcaccgccgcgccggctcgctgatcctggccgaacggccagccgcgcgtgcacccgcttgcggtcgcccaaaacactggttatatttacagcactgtatttatgaacagtgaggtgcgtgatggaacaactcgttcgtatcgtcaacgacgccgatcgccaggtgctggcatggctccgcgcccaggtcggcgacgcccgcgtcgagcgcgcggctcgccagctcgggcatacacgcaagcccttcccgtccgccgtttgccgttatctgggcatgagcgcaccggccacgctgcgccaggccgaacggccgcgcgccgcgcgcgatttctcggtcggcgatcgttacctgtcgctgatccgccagcacctcgccacacactcggccagccgatgaaatggcggcggctggctgcgtctatggcccggaaagccagtgcgcttgcggtttcgcaagcccggccggcggccaccgcgcctacctgggcgccatggcttcccgcacgaggcggccgagcgtttcgaacgccgcttcgtgcgccgcatcgaacacgcgcgtgcaagcgagccggatatagccgtcgaagcggtcggaattcgagaagatcgccccgggcgcgatcctgaccccgtgcgccagcgcggcatcgaacagcgcctcggagcgcacgccgtccggcaacgcgatccacagcagcatcccgcccggcggctggttcatccgggttccggccgggaaatgccgtgcaatcgcgtcgatcgtcacgtcgcgctgcacgcgcagctgttcgcggaaccggcgcagatggcgatcgaacgcgcccgaaccgacgaattcggccgcaacggcctgcagcaacgcggcgttgtgccggctgtgcgcgaatttcagcatcttcacgcgcgcgtgccagcgccccgcgcttatccagccgagccgcatcccggggccagcaccttgttgaacgacgggcagtagatcaccgtgccgtcgcggtcccatgccttgaccggcttgaccgcctgcggcgcctcgacgagttcgcgataaggctcgtcctcgatcacggccacgccgtgccgcgaacagagcgagacgagcgcggccttgcgcccgtcgggcatcacgcagccgagcgggttctgcaggttcggcacgaccaccacggcacgaatgtccggatacgcggtcagcgccacttcgagcgcctcgatcgacaggccggtcgtcgggctggccgggatttcgagggcgcgcaagccgaggctttcgagcaactggatcaggccgaagaacgcgggcgattcgatcgcgatcgtgtcgccggggcgcgcgaccgcacgcaacgcgagattcacggcatcgacgccgccgctcgtcgacatcacgtcgtccggcgtcaccgtcacgccgtacgacaacgcgcgcttggccatcgtctgccggaactcgggcgacccgccgacgggccccgcatcggtcagcaaggtgggcttgcgccgcaacaaccggatcgcgagcgcctgcagggttcggccggatacagcgtggccagcgcggacgcgccgccgagattcagcgcatggggcgtcgcgttggcgcggtcgatcacacgcgacacgcgctcgtgcaggcccgcgaacggcggctcgacgctcagcggcggcccgtcgctttccggcagcgtttcgagcgcgacagccgcgcggcgccgcacgaagtagccggagcgcggcttcgcttcgcaccagcccgtatcctcgagccgccggaacgcctgaatcgcggtcgacagactcacgccgtgctgtgccatgaacgcccgcaccgacggcatccggtcgccgggcgacagcgtgccggccgcgatgatgcggcggtaatgctcggcgagccgttcgtaaagcggctcgccgtccatcggcaacggtgggcgggatgaatcggtgaaaggcgtcatgcaggcgatcgtgcccgcgcggccgatggcacgccagatacagattccgggaaacccaccgatacagcggcgcaaaatcgtcgtctgcaccgcaacagattcccgtcccctgaatctgtcgtgccggtgcccgtttcctaacctgactgcacgctgtcgcctcgccgtcgcgaggccgcgcaaccgcgaagggaatcgccatgcgaacgcatcacatccggctcgacgccgggcaaagccactttgcgtggttcgacaagggcagccagttgatcgtgctggacggcgcgcttgcggtcacgctgcgccacggcgggctcgactggctgcccgacgcgccgcggcacatccgccgcttgctcgacgaaggggaatgcctgacgctcgagacggccggccacgtggcgctgtcggcccgcggcgggggcgcggtcagcacggccatcgtggaaccggcaagccgaagcggctggctcgtggcatgtcgcgcgatcctgcgcctgctgtccgggaggatgcgcggcggccgtcgtgtacacgagcattcgtgaaatggaaacttgccgtggtgtcatggaggagcgtcacgccgcgcagcatcagccgatggagatccggcgcgacccggtagcgccgtgctcatgcggatcgaccgatcctgaccggcgcaaccgccgcagtgcgcctccggcatgcggcggtcacggcatcaccgcacgcttctgcgccgttcgaaccactcgaataccgccatcccggccagcatcgcgacgacgaacccgatccccttcgccgacccgaatccgatcgacacgatcgcgggccccgggcagaacccggcgatccccagccgatgccgaacacggcacttccggcaaccaggcgcacggtgatcgcccgcagggcgggcaactgcatcggcaggccgagccatgaccgcgtccggcgcttcgcccatgcgaacgcgaacacggccaccccggtcgcgccggccatcacgaacgcgagcgatggatcccagcggcccgccaggtcgagaaaaccgagcaccttctgcggattggccatacccgacacgatgaggccgacgccgaacagcagcccagccagaaacgcgaatcctgcctgcatgtcagcctcccagcacgtgccgtcgcacgaatacggtcgcgaagcccgcgaccatgaagaccaccgtcgcgaccaccgaacgcagcgcaccgcgcgacatcccgcacacgccgtggccgctcgtgcagcctcccgcgtaccgcgtgccgattccgaccagcagcccggccgccaccagttcgaaccagcccgcatcgacctgcggcgtcaggctgttcccggcgacgtgcatcgcaagcggtgccgcgatcagcccggcgacgaacgcggcgcgccagccgcgttcgccggcgcgtgccgtgagcaagccgccgatgatgccgctgatgcccgcgatccggccgttgaacgcgacgagccacgcggcggcgagcccgatcagcacgccgcccgccagcgacagccacggcgtgaaatgaagcgcatcaagctgcatcgcgccgccccttcgcggccgggccgcagaactgttcgtacagcacgcccatcaccgcgatcgcggcggggctgtcgagcgagtagtggatgttcttgccgtcgcggcgcgtgcggaccagcgcgttgtcgcgcaacacgccgagctgctgggacagcgtcggctggcggatgtccagcgctgcctcgagatcgctcacgcagcgctcaccctgggacagctcgcagagcagcatcaaccggtcgggattcgacagcaccttgagcagcgcgcaggccgattcggcggccgcgcgcatctggtcgggttccggaaacccggcggaaagatcgtcgttcatcggcactgggagacaattaaaaatcaatattatattgatttatataatgttgcgtctcccggtctgccgacaggtggccttgcgccctccttcgctcaggcccgttcgcccgccatcgtcttcgcggcgggcacgcgcgccgcaccggcacgaaccgcgccgagcgcgagcaccgcgatcgcggcaatcatgcacggtgccgcgacgaccgcaaacgcggtcgacaacggcacgcccatcgccagcatcgcaccgcccgccatcgatccgacgaccgagccgccacggccgatcccgttcgcccagctcacgccggtggtgcggcactcggtcggatagaacgcggccgacagcgcattggcgccgacctgtgaacccgacacgcagaaaccggccgcgaacacggcgagcgcggcgccccacggcgacgcggcaaccacgccgatcgcggcgacgaacacgccggccgccgcgtagctgcaggccaggacgcgatgcgggtcgaaacggtccatcagccagccgaggacgatcgcgccgagcgtgccgccgacctggaacatcgcggtcacgtgcgcggccgtccgcagcgtcgcgccggtcgtgcgcagcagcgtcggcagccagctggacagcaggtagatgacgagcaggctcatgaagaacgtgagccacagcagcagcgtgccgcgcaacaggtcggggccgaacaggcggccaagcggcgatccggccggcttgccggcgggcgcggtgaacgacgcgttcgaaagccggggatccggcgcgatgcggcccagcatcgccgcgatccgcgcggaaggcgcgtgccgattgacgagatagcgcaccgattccggcagccgccacgcgagcaccggcaggagcagcagcggcgccgcgccgccgacgacgagcaccgcgcgccagccgtggtgctcgatcagcgcggcggccgcgagcccgccgagcgcggagccgatcgtaaagccgcagaacatcgtcgtcaccagcagcgaacggcgccgggccgggcagtactcggacgtcagcgtgatcgcattgggcatcgcgccgccgagcccgagcccggtcacgaaacgccacgcgatcagctcggtcaggccgcccgcgctcgccgacgcggcactcgcgatgccgaagcacgcgacgcatgcgagcagcaggcgcttgcggccgaaccggtcgccgaacggcccgaacacgagcgcgccggccatcagccccgcgagccccgcgccgaacaccggggcgagctgcgcgggcgacaggccccattccgcgcgaatgacggggcgatgaaaccgatcgaagcggtatcgaaaccgtcgatcgcgacgatcaggaagcacaggacgacgatcgcggcctgaaacggcgcaacgcgatgccggtcgatccattcgctgacgtcgatggacagcgtatcggtcatggtgatgtctcctccaggaaggcggtcgcgcgtcgtgtcgttgaattgcgcgccgccggaatcgggctcgccgagctgcgtcacgcagccggcgtcaggcagtcctccgcgcgccagccgtgcagccagtcgagcgcgtcgtagaactgcgcctgcgtacggccgacccagagcccgttgcgcaccagccgctcgacgcccttcgcgtgatagatccgccccatctcgcgcgccgaatacagcacgcgcgcggtgcgcggaatccgcacgcgttcgtacagcgcgaacgcggcctcgaaatcgccgtcggcccgcgcgacggccgcgccgagcgtcaccgcgtcctcgagcgcctggcacgcgccctgcgcaatgtattgcgtcatcggatgcgcggcgtcgccgagcaccgtcgcgcggccctcgctccagcgctcgaccggatcgcggtccgcggtcgcccagcgcttccacgacgtcggccggtcgagcatctgcttcggcagcggatgaatgccgtcgaagtacgacagcacttcttccttgctgccctcgcgcacgccccaggtttcctgctcgcggctgtggaacgtgacgacgaggttgtactgccgcccgccgcgcagcggatagtgaacgagatggcaatgcgggccggcccacacgaccggcgcattgatctgcagatccttcggcatgttgtcgacatcgaccaccgcgcgatacacgacgtggcccgtcacgcgatgcgcatcgccgatcagcgcctggcggatcgcggatttcacgccgtcgcagccgatcaccgcatcggcgcgataacgttcgccgtgctggtcggtcacggtcacgccgttgccgtcctgctcgaacccgcacacctgcgtgctcgtccggaactcgatcagcggatggtccttgaccgcctcgtagatcgacaggtgaatgtccgctcgatgaatcaccgcatacggattgccgaagcgctcgcggtacgcggcgcccgtatcgatgcgcgcaacctcgcgcgcatcgaccgcatccatcagttgcagccagtcggtgaacacggcccggctgcgcgcggcctcgccgacacccagcgcatcgagcgcgttgaacgcgttcgccgcgagctgaatccccgcgccgatctcgccgatctgctccgcctgttcgagcagcttcacgcggatgccctggcgcgcgagcgcgagcgctgccgcgcccgccgatgccgccgccgatcaccagcacgcgccggccgttgtcttgtgtctcgcccatctttgtctcctgcttcgtgttacgcgacgtaatccggttgccgctgcggctgcgccgcgtcgaacgccggctcgtgccgcgcgtattcgtacaccgcgaggctgcggggatacgcgctcaggtcgcaatccatccgcagcgcgttcgcgacctgcggcacgaggcacacgtcggccagcgtcggcgcgtcgccgaagcaccacgggccgtcgtccgcgcgcgcgagcagccgctcgacgccggccatcccttccgcgacccagtgccggtaccacgcggccttctgctgggccgtgaccttcagctcgctgtcgagatagcgcagcacgcgcaggttgttgaccggatggatgtcgcaggcgatcagcgccgcgagttccagcacgcgcgcacgatgccgcagttcgagcggaatcagtcgcggcgtcggctggatctggtcgaggtaatcgaggatcgcgagcgactggccgaggccgaaatcgccgtcgatcagcgccggcaccgctgcggacgggttcacgttcgcgacgtaagccgcgtcgcgatgctcgccggtgcggatgttcacgggcagcgtgtcgtacggcagccctttcagcgcgagcgcgatgcgcacccggtaggaagtcgaactgttgaagaagctatgcagttgcacgatgtcgcctttcgggaagatgcgtcagaccacgcgcacggtcagttcgccgagccgctcgacgccgaccttcatcacgtcgcccgccaccaccgcgccgacaccctccggcgtgcccgtgaaaatcacgtcgcccggttcgaggcggaagaacctcgacaggtcggccaccgtttccgcgaccgaccagatcaggtgcgacacgtcgctcttctgcttcgtcgtgccgttgacggtcagccacaggccgccgtgctcgaaatgaccgacgtcgctcgccggatgcacggggccgatcggcgccgagcggtcgaacgccttgccgatctcccacggccggcccatttcgcgcatcttcatctgcaggtcgcggcgcgtcatgtcgaggccgaccgcatagccccacacgtgttcgagcgcgcgttcgagcggaatgtccgccccgcccttgccgatcaccgcgacgagttcgccttcgtagtgatagttctgcgtctgcgacggatacgcgagatcgagcgtttcgccgtacgcgaccggcacgatcgaatcggccggcttgcagaagaagaacggcggctcgcgatcgggatcgaagcccatttcacgcgcgtgggccgcgtagttgcggccgacgcaatagacgcggcgtaccgcgaaccgggcatcgctgccggcgacggggagcgccacgggcgcttcgggcggaaaacgaaagtcatcaatggctccagccagaacgtgaatgaaggggcgcaccgcggcggcggcggcgcgcggaaaacggaatccttgaacgccgccggcgtcagtcgcgcgcttcgcgcagcaggttcagcgcggacagcacgggccggtcggaatagctgaacagcacgctgtcggacgacgccgacagccgcaccggcgcccacgacggcacgacgaagatgtcgtgcggctcgaatccgaatgcgttgccgccgatgaacgcggtgccgctgccctcgacgacgcagtagatcgtcgcgtcggtgctgcggtacgtgcggccgtcgaaaccggcgggcaggaactgcatgaaggtggcgatcgtcggcatcggccagccgcccgtcgcggggttcacatagcgcagcttcacgccgtcccacgcgtcgagctcgccgttccggtacaacacgtcgagcgcctcgcgggtgcgtgcgtacggatagctgaacaccggcgacgtcggatcgctcgcgcgatgccgcaccggcaccatgttgtgaccgaagcgggcgaagctgtcgccttccgggcgattcacgggctgcacggcttccgggtagttctccgcgaagcccgcgtcgaggtgcgcgacgagcggaatgtcgagcccgtcgagccacacgaccggctcgccgcccgcttcctccgacggattgccgtggtcgtgccatgcccacgacggcgtgatgatgaagtcgcccggatgcatcgtcgtgcgctcgccgttcacggccgtccacgcgccgcggccttcgacgatgaagcgcagcgccgactgcgtatgccggtggctcggcgcgatctcgccgggcaggatcagctgcagccccgcgtacaggctcggcgtcatgctcgacttgccgggcagcccgtggttctccagcaccagcacgcggcgcacggcttcttccgcgctgatcacgctgccggcctgcatcacgagatcgcgcacctgcgcgtacttccagatcgcggcctgcgcggccggctgcgggatttcggcacgaggttgtgcagcgattcccacagcggcgccaggcgttgctcggcgatccgtgcgtagtaggcggcgcgcgacgcgtccggatgggtcgtcatgatgtctcctgggagtcggccgatcggcgtcggcgctatgtcgggtcggggaccgtgctgcagtccgtcagcagatttatattcgacccagacatacccggtaaaatgatcaaatcatctaatccatatcattctggatataccttctcgcgacgaggcatgcgatggactggacccaccggctgcgactgcggcatctgcaggtactgttgagccttgccggcaccggcaacctgagccagtcggcggtggcgctcgcgaccacgcagcccgcgctgtcgaaatggctgaaggaactggaagaggacgtcgggctgccgctgttcgaacggcatgcgcgcgggctgcggccgaccgcctacggcgaagcgctgatcgagcatgcgcgccgcgtcgaagcgcagctcgacgtcgcgcgcgacgacatggccgcgctgcgcgaaggcggcagcggcctcgtgacgatcggcacgtcaggcgtcgcggcggccgacacggtgccgctcgcggtgtcgcaactgctcaaacggatgccgcgcgcgcaggtgcggctcaccgaaagcacgatgaaccagctgatgccgcagctcgcgcgcagcgaactggatatcgtcgtgggccgctcggggtcgacatccgtcgatccgctgctgcatgccgaagcgctgtatgtcgatccggtcgtgttcgtcgcgcgacccggtcacgcgctcgccggtgcggcgtcggtcggctgggacgacgtgctcgcctgttcgtggatcgtgtggccgtcgggcacgcccgtgcacaacgcgctcgaggccgcgctgacggccgccggccgcgttcggccgccccactgtgtcgaatcgaattcgtcgatcctcaacctcacgctgctgaacaacaccgacctgctcggtgtcgcgtcttatcgtgccgcgcagcgcttcgagcaattgaacgcgatccggatcctgccgatgcagctcgaaggccagggcgcggtgtcgatgtactggcaccccgacagtgcgaatcgcgcggcggtggccgcgacgatcgagtgcctgcgcgcctgcgccgcgccgcaggtcggcggatgggagaaagtgacggcggaatgaatgacgcggcccggtgtcaaccgggctgcgatgctgcgatgctgcgatgctgcgatgctgcgatgctgcgatgctgcgatgctgcgatgctgcgatgctgcgatgccgcgatgccgcgatccgtcacgcgccatcgcaggaagccgtaccgtccagcatcagcgtgccgacccgcgcgggcacgagcggcgtgcgcggtaccggcggcgtccagccgaacaacgcctgtgcagccgcaccgcacacgcggccctggcatgcgcccatcccgcaacgcgactgcagtttcgcggccgtccagcccggcgcttgcacgactgcctcgaaacgcacgtcttcgcagcgacacagcagcgtatcgggccgcgccagccggcggaccggctcgcggatcgcaaaccgttcgcgcacggcgtccgcgaacgcctgccagtgcgcacgccgcgcgacgagcgcagccagcggcgccgtctgcccggttgccgcatggccggcgatctcgccttcgatcatcgccagttcgctgccgccgacgcccgtgcactcgccggccgcaaacaccccgtcgcggctcgtacgctggtgcgcgtcgaccgctaccgcgccgttgtcgatccggcagccgagatggctcggcagcaccgtattcggcacgaggccgaaaccgcacgcgagccggtcgcagtcgacgtcgaactcgcggtcgccgtgccggatccgcacgcgttcgagccgcttgtcgccgaacgcctcgacgacgtgcgcatcggcccggtacgcagccgtgacgagcttcgcggcctgcgcgagcttcgacggccagcgccacagcccggcgccgaagccggccacatcgccccagcccgcctgttcgagcacgtgcgacacgcgcgcaccggcctggcgggccgtcgccgcgctcgccagcagcagcggcccgctgcccgcgatcaccgtgcgctgcccgcgcacgtcgaggccgtacttgaccagcgcctgcaggccgcccgcaccggtgacgcccggcagcgtccagcccggaaacggcagcagcagttcgcgtgcgccgcagcagagaatcagcgtccggaaatcgagcagcagcccgcgttcgtcgtcttcgagcagcagcgtgcccggctgcgtttcggcgacgatgcgcgtcgccgcgagatgcgtgacgttcggctgccgcaatacggcgagccgctcggtggcgaccggcgcgggcgtggccgctgcgccctgtcgccagatctgcccgcccgcgcgcgggttgtcgtcgacgatcgccaccgtcgcaccgcttcgcgcggcggcccgcgcggccgacagcccggccgggcccgcgccgacgatcgcgatgtcgacgctcagtcgttcctgtttcatcgcgtacgctccacctgcatcccgtcgcggcacaacgtctggcaagccaggcggcgccgcccgtcgatcgtcatccggcactcctggcagatgcccatcccgcaaaacggcgcgcgcgccgcgccgtgcacgacacgcgcgtcgtgtcgtcgccgctcgccgcaatggcggccgcgacggtcgcgccgtcggccaccgtcagcgcgcggccgtccagatgaatgatcatttcagcctccgccgggccgccccaaggaggctgacggcccacgggggcagcgaacgaagtgagcgtggggtcgtttcatttcagcctccgccgggccgccccaaggaggctgaccgcccggggcagcgaacgaagtgagcgtggggtcgtttcatgtcagcctccgccgggccgccccaaggaggctgacggccctcgggggcagcgaacgaagtgagcgtgggggtcgtttcatatcagcactccggctacaagggacgcggtcaggaagcgtcccggcaaatacggttcgatatcgatgggcggccgctcgccggccatcagcgcggcgacgagccgcgcgctgcccggcgcggtcgtcacgccgagcccttcgtgcccgaccgcgagccacacgcccggccgtgccgggtgctcgccgagcagcggcaggccgtctgggctcgcggaacggaaccccgtccacgcgcggatgccgttcaggtcggccaggtccggcagatagcccaccgcgcgacgcagcatgcgcgcgagcacgggcggctcgacttgggcgtcctcggtgtcgaactggcgcgacgagccgatcagcaactggccggtcggccgcggctgcacgttgaacgcgaccgacgtgccgtcgctcgcatgcgcgctcgccgcataacccagctcgacgagctggtgcgacacctggcccggatagcggtcggtaatcagcagatggccctttttcgggcgcagcggcagttcgggcagcagcgtgcgcgccgcaacgccgttcgccacgaccacccgctccgcgcgcagcgtgtcgccgctcgcgagcgtcacgctcgggccgtcgaccgcgacggcccggtcgcgccgcaacgtgacgcgcggcgcgcgctgcaacagccagttcgcggtgacgggcgcatagaggatcgcgtcgcccggaatcttcagcgcgccgccgaggcccgcgcgcaacatcggctccagttgcgcgagcgccgccgcgtcgatcagttcgccggccacgccgtgcgcggcgagcgccgcctgcttcgcgcgcgcgagatccatctcgtgcgcatcggccgcgagccacagcgtgccgcagttgcggtacgcgcagccttcgggcatctcgccgctcaacgcgcgccacagttcgatcgagtaatggctcagcgcgagttcggccgcgttgtcgtccatcgcgacgaggtgccccatgcccgcgccggtcgccccgccgctcgcgtcgtcgacgacgagcacgcgcagcccgcgctgcgcgagttcgtgcgcgcacgcggcgccgacaatgccggcgccgatcacgacgacatccgtcttcgcgtcgctcacggcgcgataccccagccgaacggatcgtcttcctcgatcaggagcgtcgcttccgcgctcaggtgcgcactgccgcggatcgtcggcacgatcccgccgtcggcttcttcgtagctcgcgtggaacacgctgccgatcacgctcgcctgccgccacacggcgcccggcgcgagcttgccgtcggccgcgaggcacgcgagcttcgcgctcgtgccggtgccgcacggcgaacggtcgtatgcgaggcccgggcacagcacgaagctgcggctgtcgtgctccggatcgtcggcgaacagctcgatatggtcgatctcgccgccgttcgcgccggtgatgcccgcgcgttcgagcccttcgcgcacggccgacgcatacgcggtgagcgccgcgacgttgtcgccggcgacgcgctgcccgtggtcgctgatcaggaagaaccagttgccgccccacgcgatgtcgcccttcacggggccgtaacccggcacgtcgagcgcgacgcccttcgcatggcgatacgcgggcacgttgcgcacgctgaccgacaggtcgtcgtgcagcgtcgcctcgacggtaccgaccggcgtttcgatccggtgcacgccgggcgcgatgcgccccatgtggtgcagcgtgcgcacgacgccgatcgtgccgtgcccgcacatcccgagatagccgctattgttgaagaagatcacgccggccgccgcatcgggcgacacgggctcgcacagcagcgcgccgaccagcacgtcgctgccgcgcggctcgaggatgcatgcggtgcggtagcggtcgtgctcgcgcgcgagcacgtcgcggcgctcggccatcgtgccgctgccgagcgcggggaagccggacacgacgagccgagtgggttcgccgcccgtgtgcgaatcgatgatctggatgcgcttcatcatgagccgtccgaagtggggaaaggagcatagcttcctccgtcgcgcgtccgtccgcttgtggcttttcgatgaggacgacgacgaaatcggcatagtgcgaagcgcccttcccgcgccgtccggccgctgtgccgatttcgtcattttgctccgcgatacgactcaagcgtgatgggcatttgcgcggcgatactggttgccacaccgacacacccgtcggccgaccgatacgaacgtaggagatttcagtgagccgcaaagccattcaatggaccggggttttcccggccgtcagcacccagttcaagcctgacttttccctcgacatcgacgccacgcaccgtgtggtgaagaacctggtgaacgacggcgtgtcgggcctcgtggtctgcggcacggtcggcgagaacacgtcgctgtcgacgagcgagaagctccaggtgatcgaggccgcccgcgacgcggcaggcggcaagattccggtgatcgccgggatcgccgaattcacgaccgaattcgcgcgcaatacggtgcgcgaagcgcagcgcgtcggcgtcgacggcgtgatggtgatgcccgcgctggtctactcggccaagccgcacgaaaccgccgcgcacttccgcgcggtcgcgacgagcaccgacctgccggtgatggtctacaacaacccgccgatctacaagaacgacgtgacgcccgacgtgctgatcgcgctgcaggattgcgagaacatcgtctgcttcaaggattcgtcgggcgatacgcgccgcttcatcgacctgcgcaacgcggtcggcgatcgcttcgtgctgttcgcgggcctcgacgacgtcgtggtcgagagcatcgccgtcggcgccgaaggctgggtgtcgggcatgtcgaatgcgttcccgaaggaaggcgagacgctgttccgcctcgcgaagcaaaagcgtttcgacgaagcgctcgcgctgtaccgctggttcatgccgctgctgcacctcgacgcgcgccccgacctcgtgcagtgcatcaagctgtgcgaagagctggtcggccgcggcagcgcgatcacgcgcccgccgcgcctcgcgctgcagggcgacacgctcgcggaagtgaaggccatcgtcgcgaaggcgctcgaaacgcgcccggcgctgcccgacgtcggtctctgaccgactccccgtgcggcggtgcgccggccctgcgcctgcgcgccgccgtctccggtccggcatggcctgcgggcccgttcgtaccggcgccaacccgcgccgcgcatgaacgccccgccgcccgccccggtcgttcgaaccgggcgacgccggccggcaggcctgcgccgctgctccgtcggagcgcgacgcacctcgagcctgtgccgatattcccccaggagacaagcccatgccaggccaaggcaacgcacacccgtctgtcccgctttcccgttccgcgcaccccgacgcgggtcacggcaagttcaagaaacagctgtcgctgaccgatctcacgttcatcggtctcggcgccattttcggttcggggtggctgttcgccgcgagtcacgtctcgacgatcgcgggcccggccggcatcttctcgtggctgctcggcggcttcgcggtactgctgctcggcatcgtctactgcgaactcggcgccgcgctgccgcgcgcgggcggcgtggtccgctacccggtgttctcgcacggcccgctgctcggctacctgatgggcttcatcacgctgatcgccttttcgagcctgatcgcgatcgaagtcgtcgccgcgcgccagtacgcggccgcgtggtttccgggcctgacggtggaaggatcgagcgacccgacgacgctcggctggctcgtgcaggccgcgctgctgtgcttcttcttttacctgaactattcgagcgtgaagacgttcgcgaaggcgaacaacatcatcagcatcttcaagttcatcgtgccgctgtcggtgatcgcggtgctgttcacgttcttcaagccggcgaacctgaccgtgcacggcttcgcgccgttcggcatgccgggcatcgagatggccgtgtccgccggcggcatcatcttcgcgtacctcgggctcacgccgatcgtgtcggtcgcgagcgaggtgcgcaatccgcagcgcacgatcccgatcgcgctgatcctgtcgatcctgctgtcgacgctgatctacgtgctgctgcagctcgcgttcatcggcagcatcccgaccgcgatgctcgccggcggctggcacgacatcagcaaggcgttcacgctgccgtatcgcgacatcgcgctcgcactcggcgtcggctggctcgcggtgatggtcgtcgccgacgcgatgatctcgccgagcggctgcggcaacatctacatgaacgcgacgccgcgcgtcgtctacggctgggcgaagacgggcaccttcttcaaggtgttcacgcgcgtcgacgaagcgtcgggcatccgcgcgcgggcctgtggctcacgttcggcctcgcgatcttctggacgatgccgttcccgtcgtgggaagcgctgatcaacatcgtgtccgccgcgctggtgctgagctatgcggtcgcgccggtctcggtcgccgcactgcgccgcaccgcgcccgacctgccgcggccgttccgcgcgagcgcgttcggcatcaccggccccgcatcgttcgtgatcgccgcgctgatcgtctactggtcgggctggagcaccgtgtcctggctgctcggcctgcagatcgtgatgttcgtcatctacctcgcgtgccgccgctgggtgccgaccgcacacctgagcctcgccgaacaggtgcgctcgtccgcgtggctgatcgcgttttatgccgcgatgatcgtgctgtcgtatctcggcggcttcggcggcacgggccggctcgcccatccgtacgacacggttgtggtcgcggccgtcgcgctcgtcatctactactgggggcgaatacaggcgtccgttccgacaagctgcagctcgacgacgacgaggactgacgcgccccgccgtttcccatgatcccttcggccgggcgcgccacgcccggccccgctttttccgaggaaaaccatgcaactcacaggtcagctcctgatcggccagtccgccgtcgccggacagaacggcaccctccacgcgatcgccgccgccaccggcgaacggctcgagcccgccttcggcggcgcgagcctgcacgacctggagacggcctgcgcgctcgccgacgacgcgttcgacatctatcgcgaaacgtcgctcgaagcacgggccgcgtttctcgacgcgatcggccgccacatcatggcgctcggcgacgacctgatcgagcgctgcgtcgtcgaaacgggcctgccgcgcgcccgcatcgaaggcgagcgcggccgtacggtcggccagctcgcgctgttcgcgtcgctcgtgcgcgacggcggctttctcgacgcgcggatcgatccggcgcgccccgagcgcaagccactgccgcgcgtcgacctgcgcctgcgcaacgtcgcggtcgggcccgtcgccgtgttcggtgcgtcgaatttcccgctcgcgttctcggtcgccggcggcgatacggcgtcggcgctcgcggccggctgcccggtgatcgtcaaggcgcattcggcgcaccccggcacgtcggaactcgtcggccgcgcgatccagcaggccgcgcgcgaatgcgggatgcccgccggcgtgttctcgctgctgttcgacgcatcgcgcgagatcggccaggcgctcgtcgccgatccgcgcatcaaggccgtcggtttcaccggctcgcggcgcggcggcgtcgcgctgatgcacatcgcggccgcacgccccgagccgattcccgtctatgcggaaatgagctcgatcaaccccgtgctgctgtttcccgccgcgctcgacgcgcgccacgacacgatcgcgccgcagttcgtcgcgtcgctcacgctcggcgccggccagttctgcacgaatccgggcctcgtgctcgcggtcgacgggcccgcgctgcgtgcgttcgaggaaacggccgccgccgcggtgcgtgcagcgcccgcgcaaacgatgctgacgccgcacattcacgccagctacgaaggcggtgtcgcggcgctgcgcgctcacgctgcggtcaagctgctcgcgcaaggcgcggaaggcgaccgactgcaggcccgcgccgccctgctggcgacctcggccgacgcgttcgtcgcgcatcccgagctgcgcgaagaagtcttcggccccgcttcgctgatcgtgcgctgcccggacgccgacacgctgcatcgcgtgctgaagtcgctcgaaggccagctaacgatcgccgcgcatctcgccgacggcgacgccgccctttcaccgcgctgcgcccgaccttcgagcgcaaggccggccgcattctcgtcaacggcttcggcacgggcgtcgaggtcggccatgcgatggtgcacggcggcccgttcccggcgacgtccgacacgcgcacgacgtccgtcggcgcgcgtgcgatcgagcgcttcctgcgccccgtgtcgtatcaggacctgccggatgcgctgctgccggaagcgatccgcaacggcaatccgctgaacgtgccgcagcgcatcgacggcgtgcccgcgccgcgcgaggtgaaccatgtctgagcagatcgccgaagtcgtcctgtcgctcgatgaagtccacgcgctcgcgctgcgcgtgctgacgcaccacggcgtgtccgacgcccatgcccgggccatcgccaacgtgatcacgcagggccagcgcgacgaatgccattcgcatggcgtgtatcggctgctcgtgtgcgtgcgttcgctgaagaagggcaaggtcgatccgcaagccgtgccgacgctgcgccggctgtcgtcgtcgatcgtcgcggtcgaagcgcatcgcggcttctcgctgctgagtttcgaaacgggcctgcccgtgctcgtcgagatggcgaaacagcacggcatcgccgcgatgacgatcaaccattgctaccacttctccgcgctgtggccggaagtcgaggcgatcgcggccgaggggctggtcggcatcgcgatgaatccgagccatagctgggtcgcgccggaaggcggcagggagcccgtgttcggcacgaacccgatcgcgttcgcgtggccgcgcccgggcggcgtgccgttcgtgttcgacttcgcgacgagcgcgatcgcacgcggcgacatcgagctgcatgcgaagcaaggcaaggcaatccccggaatgggcgatcgacgccgagggccggccgaccaccgatccgaaggccgcgctgcagggcgcgatgcgcacgttcggcggccacaaggggtcggcgctcgcggcgatggtcgagttgctcggcggcgcgctgatcggcgacatgacgagccgcgagtcgatggacttcgacgaaggcgtcggcgcgacgccgtgccatggcgagctcgtgatcgccttcgacccgaaggtgttcctcggcgacgatctcgacacggggctcgcgcgcggcgagcggatgttcgaatcgatcgtcgcgcagggcgcgcggctgccgtcgcaacggcgcttcgacgcccgcgcgcgcagcatcgcgaacggcgtgcggattccgaaggcgctgtacgacgagatcctgacgctgctcgactgatcgcccgcgcacggggccggatcgcgcggcgatcaccgatcgatgcgcggcccggtcggctcccgcccggtcgcgcggccgtcccgcggccttcggcacgttttacgccgggcacgcctgcggcgccggttgccggccccgcgggcgccacgcccgcggcggctgtgggataatcgccgggtttgcccagggcgcagctcaagaggttgttcgcacgggcgcgagaggcccttattccccgtgcctccacccttttcccgcgatatttcttcagcaaccacaatgcccacttaccgttccaaaacttccaccgccggccgcaacatggcgggtgcgcgctcgctctggcgcgccaccggcatgaaagacgacgatttctcgaagccgatcatcgcggtcgtcaactcgttcacccagttcgtgcccgggcacgtgcacctgaaggatctcggccagctcgtcgcgcggagatcgaggctgccggcggcgtcgcgaaggaattcaacacgatcgcggtcgacgacggcatcgcaatgggccatgacggcatgctgtattcgctgccgagccgcgacatcatcgcggattcggtcgaatacatggtgaacgcgcactgcgcggacgcgatggtctgcatctcgaactgcgacaagattacgccggggatgctgatggccgcgatgcgcctgaacatcccggtgatcttcgtgtcgggcggcccgatggaagccggcaagacgcgcctcgcgaacccggtcaccaagaccgtcgaactgaagaagctcgacctcgtcgacgcgatggtgatcgcggccgacccgtcgtattcggacgccgacgtcgctgaagtcgaacgctcggcctgcccgacctgcggttcgtgctcgggcatgttcaccgcgaactcgatgaactgcctgaccgaagcgctcggcctgtcgctgcccggcaacggcacggtggtggccacgcacgccgatcgcgagcagctgttcaagcgcgccggccgccggatcgtcgagctcgcccgccagcactacgagcaggacgacgaacgcgtgctgccgcgctcggtgggcttcaaggcgttcgagaacgccatgacgctcgacatcgcgatgggcggttcgaccaacacgatcctgcacctgctggcgatcgcgcaggaagccggcatcgacttcacgatgaaggacatcgaccgcctgtcgcgcgtcgtgccgcagctgtgcaaggtcgcgccgaacacgaacaagtaccacatcgaggacgtgcaccgcgcaggcggcatcatggcgatcctgggcgaactcgaccgcgccggcaagctgcacaccgacgtgccgaccgtgcacgcgccgtcgctgaaggatgcgctcgaccagtgggacatcgtccgcacgcaggacgatgcggtccgcacgttctacctggccggcccggccggtatcccgacgcaggtcgcgttcagccaggacacgcgctggccgagcctcgacctcgaccgcgccgaaggctgcatccgctcgtacgagcatgcgttctcgaaggaaggcggcctcgccgtgctgacgggcaacatcgcgctcgacggctgcgtggtgaagacggccggcgtcgacgagagcatccacgtgttcgaaggctcggctcacgtgaccgaatcgcaggatgaagcggtcgagaacatcctcaacgacaaggtcaaggccggcgatatcgtgatcgtccgctacgaaggcccgaaaggcggccccggcatgcaggagatgctctacccgaccagctacatcaagtcgaaggggctcggcaaggcatgcgcgctgctgacggacggccgcttctcgggcggcacgtcgggcctgtcgatcggccactgctcgccggaagccgcggcgggcggcgcgatcggcctcgtgcgcgacggcgacaagatccgcatcgacatcccgaaccgcacgatcaacgtgctcgtgtccgacgaagagctggcgcgccgccgcgaagagcagaacgcgaagggctggaagcctgcgcagccgcgtccgcgcaaggtgtccgcggcgctgaaggcctacgcgaagctggtcatgtccgccgacaagggtgccgtgcgcgacctgtcgttgctcgacgactgacgcgagtagtacggccggctgcccgccacgcgcagccggtcgggctggggcaggacaccccgcccgcgctgctgtggaagccgctctccggagcggctttttcgtccggcgcccgggaatccccagcgccggcgacatcagtgacggaaatcttcggggccaccacctccgccaccaccgtggttaccgccaccgtttccaccaccttgcggccgcgcataaccgccgccgcccccgcctccctgacgcaccggcggcggcatcggacgcgcgtcgcctccctggtgcatcgccggcggcatcggacgcgcctcgcctccctggtgcatcggtggcggcatcggacgcgcctcgccacccggtgcgggcggcgggcgcagcacggccggcggcgggccggacggacgcgcgttgcccgccccgcccggcatcggtgaaggcgccggtgctgccggcggcggtgtgcggatcgcgccgttccagccgccgcgtgcagccgacggccgcgcgtcgtgcacgggcggcgggccgcccggtgcaacctgcatcggcccgcccggttgcggacggccttgtcccggcggcatgccccggggccgagccgcggttccggacgatgcgcccagcgatcgcggtcgtgataccacggacggtgccggtaataacgatcccagtacgcggcgatcgcgaatcccgtcaccggaaccccgatgatcgcgccgtattcgagcaacggcacgtagctgccctggtacggatactcgagcagctgcgcatcgatccagccgcgcacgcccggcagcgcgacgtcgcaccacgagtagtcgctcaggcagccgaagacgtccagcgccgtgtcgggcggaatctgcgctaccaccggatagtcgggcgccggccccgcaaacagttcggccggcgagttcgtgtaggcgctgctctgcgcgtcggcgacgcccggcgcggccgcgaggccgagcaggacgacgtacagacttcggacaatcgaattcctcatgatgctctcccgcgcggtgccgccgcgcgccggtcagtgccgatgcccgccccagccgccacccgagtggccgccgccccagtggccgccaccccacggacgatgccagtacccgccgcgtccgcgccagtagccaccgccccagccgccccagaagccgaccgagatcgccggcgctccccagccgtaccagcccgggtaatacgcgggggcatagtacggatacggatagggatacggcggcggataggccggcgcgacgtagacgggagccgggtcggccacgggcggcgcgaccgccgtcgagccctggctcggtgcggcgctacccggtgcagccggcgtgacgggtatctcgcgctgcgtcagcgtggccggcgccggcgcgtaatacggcgcatagccgtacggactcgtgtaataacagccgccgaaggccagcgtggtcaacgcgaataccgcacacctcgcggcaggaatcggggtcatttcttgctccggcggaatctgcgctgccaggctgcgcgcctgactctagcttcccctgcagatttccgcccggtatgatcggttactttttgtttccagcaccagacgcgcgcgcaggcacgccgcgtgctggcaggtctgccgcgctcgcgttgaagttcgcgcaaatgccctcaacttgaacgatgtcaggctggccggcgcggacggggttcgcgagcaaccggcggcccgaaaccggcgggcttcggcccgcccagacaggagcgcggctcacgccgccatcgacatgactacgccacgccccactccccgggcggacacgccgctcgatccgatcatccagttgctggcgctcgccggcgaacagggttatctgacccacgccgacctcgtcgacgcgctgccgcccgaaagcgacagccccgacgcgctcgacgtcgtgcgcgccgcactcgccgacatcggcatcgccgtgctcgacgagccggccgcgcctgcgccgttcgccggttcgtcgccggtcgacgtcgatcgcgatgcgctcgacgaaggccgcgcgatgctcggcgacctcgcacgcggcacgagcgcgtcgaccgacccgctcgcgctctacatgcggcgcatgcaggcggtgccgctgctcacgcgcgaaggcgaaatcgtgcttgcccgcgaactcgagacgggccgtcaccagatcctgcatgcgatcgccggctatccggcggcggtcgactcgttgcttgcgcgtcaccgcgcgacggcgacgaccggcagcgccggggcttccgacggcgacggcgacgccaccgacacgcccgcgccggccagctacgacgcactgcagacggccgtcgcggccctgcgcggcgcgttgcacgcgcatggcgtccgttcggacgaataccgtgacgcgcgtaaccgcatggccgccctgctgggctcgatcgcgtggctcgcaccggcggtcgacgacgcgagccgcgtcgtgggcacgctcgcgtccgcgccgcacggcaccgaagcaggcgaagccgccagcttcgacgcggtcgcgcggcgggcactcgccgcagcgctcgccgacggccagcagaaagtgcgcgacgccacgcgcgcgatgctcgaggcgaacctgcggctcgtgctgtcgatcgcgcgcaagtacatgaaccgcggcgtcgacctgcccgatctcgtgcaggacggcagcctcggcctgatgcgcgcgatcgagaaattcgaataccggcgcgggttcaagttctcgacctatgcgacctggtggatccgccaggcgatcgcgcgcgcggtcgcggatcgcgcgcgcacgatccgcgtgcccgtgcacgtgggcgaccagtaccagcgtgtgcaacggcatgcgctgcgttttcaccagcgcacggggcgccgggcgacgccggccgaactcgcggccgaaaccggcctcgacgaggacaagctgcgtgcggtgctcgcgctgcctgccgagcccgtgtcgctcgatgcgccgctgcccgacgcggacaccggcctcgtggagctgatcgaggatcaggcgtcggccagcccgttcgagcaactggcggacacgcgcatgcgcgagtgtgtgcggtcgctgctccggtcggtcacgccggccgaggccgacgtgctgcgccggcggttcggtctcggcggcgccgagcccgatacctacgatgcgatcgcgcacgacgccggcatgtcgcgcgaacgcgtgcgccagatcgagaaacgggcgctcgccgcgttgcgcacggccgccgaggccgagaacgcgcagtcgtttctcgacgcgtgaccgcatcacgcgacgcacggtcgtgcccctaccggcacgaccgtgcacctcgcacctgtgctacgtttgctattgacgtgcgtcaagttttcttcaacgcgtgtcgcgacaatgatgaaaagccgaccggcgcatcgttcgccgtgtccattccgtttgtgcttcccgggtccctcgcgatgcagacgagcgccagccaaacgtacgaggaaaaccggcatatcgcggcctgcctgcgcgaggcggcgcaacggctggctgaccagggcgcgaatccttaccgggtcgccgcgtaccgcgcgtcggccgggacggtcgaggcgctcgacctcgacatccgcacgctgttcgagtccggcggcgtcgatgcgctcggtacgttgcccgagatcggcacgggcgtcgcccaggcgattgccgagctgctggtgaccgggcgctggcggcagctcgaccggctgtgcggcgacgccgtacgcacctccgcattcgaagcggtaccgggtatcggccacgcgctcgcgttacgcattcacgacctgcttcacatcgatacgctcgaggagctcgaacgcgcggcccgcaacggccagctcgaaacaatctcgggcgtcggaccgcggcgcgcagccggcatccgcaccgcgctcgacgacgtgctgagccgccgccggcgctggcagggccacgtgcaggacgccggccccggcaccgagcccccggtcgaactgctgctctacatcgaccgcctgtaccgcaacaaggccgcggccggcgtgttgccgacgctcgcgcaccggcgcctgaacgtggacggttacgtgccgtcgcccgtgatgcacatgaccaagggcggctggcatttcacggcgctgtgcctgcttgccgcgatgcgcacgccggaggcctcccgcccgaccgactgggtctcgctctatttctacgacgccgggcagcgcgaacaccagcgcaccgtcttcaccgaaacggtcggctcgctcgtcggcaagcgcatcgtacgcgggcgcgagcaggagtgccgcgtgtactacgcgggctgagtcagtcagtcgtcggaggtttcgtcgacgtcgaacgccacgccgagcacggacgcgatctcgcgacaggcatgagtgagcgcgcgtgtgcggcgaccggaatattccaccgcgagatcgaaccaggtcgaatacgacacgtagtcggcgccgcttttccggttcggcacgtcgaaccacaacgtcaccgtgtagccgcccttccagcgtatcggtatcacccgcgtgagccgcaatctcgtgatcgcgccgtgacggaagcggaagctgtcgtcgcccacgcggaaccccgaccatgcgccgtcgttcgacacgaacacggtcagcgtttggtcaggtggcgcggccggcccccatcctcgacggcaagttcggccatcgacaccatcgacgcgcccgaatcgccgtgccccgtctcgacgtccacatacgattcgatcgtctgcttcgcgttgtcgtagaaatagcgcgcgacgtcggagcgcgcgtcgccagccatcggatctacttgcttgaatcgtgcatgctcgccgtatcgaagcggtacgtcgggcgcgtcgccggcatcgccggcgtcttcggcgtcgtcagccggttcgtcgtccggactgtcggccggtatggcctgcgcggccgtctcgggctgcccgatcccccacgccgtcgcttcacccaggcggttccccacgtcagcagggctgtctgcaccgccagcacgaccgccatcgtcgcgcaccccgcgagaaatccgtagtgcggcccgaccttcgatgccgcgtacgcggccggaagcacataaagcaccagcaatggcgcaagcaataacgacacgcgtcaaccccgttgttcctgttttcgttttcgaattccggccgggatcggcaccgccgccaccctgccgccggactgctgatgccacccgcacgtcgagcgggcgcgcaacctatgcgccttccgccttcgcgcgacgcgccggattgcgatgcgcggcaatgcgcagcagcttctggaacgacgggcattcgagatggttcaccgccgggcacacggccgcgtgccgcagcgcatcgcgcacggcgccgagacggcggatcgtgcggtcgagttcgtcggccttgctgtcgagcttcgcgcgatcgatcgcaggcaggccgcccgtgtccaccatcgcgaggatgtcgtcgagcgaaaaaccggcctcgcggcccagcgcgatcagtgccaggcgctccagcaccgactcgtcgtattgccgccgcagcccgtggcggccgatcgggacgatcagccccttttcctcgtagtagcgcagcgtcgacgcgggcaatcccgagcgccgcgccacatccgcaatgtccagccgactcatgcttgacctcaagtgaacttgaggttgcaagataggcgctcgactccataaagacaagccctgactgccatgaaaccgccgaatccacgctgtatcccgctgcgccgcgcaaccgtcgccctccgcgccggtggttcgcgatgagcctgtccgacgtcctgctcaacctgttgctgatcggcacgggcgcgacgctcgtgatggatctgtgggcgctgtttcgccgacgtgcgttcggcattccgtcgctcgactatgcgctggtcggccgctggatcggtcacatgacgcaaggccggttccggcacgtgtcgatcgccgccgcgccgcccgtgccgggcgaacgcacgctcggctggatcgcgcattacgcgatcggcatcgcgtacgcggcgctgcccgtcgcgatcgcgggcacggcatggatcggcacaccgacaccgctccccgcgctcgtcgccggcctcgccagcgtggtcgcgccgttcttcgtgatgcagcccgcgttcggcctcggcatcgcggcgtcgcgcacgccgcacccgggcgtcgcgcgccggcgtagtgtcatcgcgcatctgtcgtatggtgtggggctttatctggcggcgttcacgctggcagcgctgccccgttgagcacaccgtcttgccgacgccgtgacgggtagcgccggctcacggagccgacgtcgacgcccgcacagcgcttcgccgaagtgcgccgggcgctttgtcctgcgcgagccgaacgatggccgcgccgacataacggcaacggcaatgaccacgcccatgccgtcatacgggccaacgtggcacgcctgcgcacggccacccggtattcccgtagcggtcaacccgttcatccggccggcccggatgacgctgcccatcactcccgccgcactcgatcaggttgtggcgcacgcgcccgagcagccgcaccagcgtatcgcgctcgtcgggcgtgaagccgcgcaaaccgtcgtcgacgacggtgtcacccacttcgagcatctgcggaaagatctcgcgcgacttgtcggtcagccggatcacgaacgcacggcgatcgtcgtcgttcgcgacgcgctcgatccagccataactttccatccggtcgagcaaccgggtaagcgagatcggcgcgatctcgagccattccgcgagccgcgcctgattcatctcgcccttccacgtcaggtatgcgatcacgcggctttgcgcgcgcgtcagcccgatgcgcttcgcgcgccggtcgaacaggcgcccgttcaggcgggccacgtcagaaatcaggtagccgatccggttctcgtaggtcttgtccatgcggggattatagggtcaagccgacagccacccatcgctcgcggccaggcgataagccgatctataataagcgtgcttataattccagcgataccggatcgccgcccacggcgaccgccccacggagacaccccttgaaccccgccgccgacgcccccgcctcgcccgccctgaaccggccgatgctgaccctgtcgatcatgctcgccacgctgatccagaccctcgacagcacgatcgcgaacgtcgcgctgccgcacatgcaaggcacgctgtccgcatcgcaggacgagatcacgtgggtgctgacctcctacatcgtcgcggcggcgatcgcgacaccgctcaccggctggctgtccgaccggctcagcgtgaaacggctgctgatcgtgtcgatcgcgggcttcacggtcgcatccgcgctgtgcgggctgtccgagacactcgtgcagatcgtcggcgcccgcctgctgcagggcgtgttcggcgccgcgctggtgccgctgtcgcagtcgatcctgctcgacatcaacccgcgcgagaagcaaggccaggcgatggcgatctggggatgggcgtgatggtcggcccgatcctcggcccgacgctcggcggctggctcaccgacagctacaactggcgctgggtgttcttcatcaacgtgccgatcggcgcattcgcgctggccggcgtgatgaccttcctgcccgcccgtgcgccgcgcccgcatgtgaaattcgacgcgttcggcttcgcgacgctggcgctcgcgatcggcgcgttccaggcgatgctcgaccgcggcgaacagctcgactggttcggctcgtacgagatccgcatcgaggcgatcgtcgccgcgctcagcttcgcgttcttcctcgtgcataccgcgaccgtcggcaaggcgtcgttcttcaagtcggaactgctgcgcgacccgaacttcgcgacgggcacgctgttcatcttcgtggtcggcgcggtgctgtacgcgacgcgcgcgctgctgccgccgatgctgcagaacctgatgggctacccggtcgcgacgacgggcctcgtcaccgcgccgagcggcgccggcacgatgatcgcgatgctgttcgtcggcaggctgctgaaatacgtggatgcgcggatgctgctgctcgcggggctgtcgatttccgcgctcgcgctatggcagatgatgcagtacacggtcgtgctgtccgaggcggacatcgtgtggccaggcgtggtgcagggcttcgggctggggctcgtgttcgtgccgctgagcgcgctgtcgttctcgacgttgccgcccgacctgcgtgcggacggcacggccacctacagcctgatgcgcaacatcggcagcagtatcggcatctcgatcgtgcagacgctgatgacgcgcaacacgcaggtgtcgcacgccgatctcgccgcgcagatcacgccgttcaacccggccgtgcaggcgatggccggcagccatctcgacttcgcgctgctcgaccgcacgatcaaccagcaggcatcgatgatcgcctacctgaacgatttcaagctgatgttcgtcgcgacgctgctgatgattccgcttttgctgctgatccgcccgccgcagaaaacggcgagcgtggagatcgcgcatgcggcgatggattgacaatgcgacgggcgcgcgcccgtcgcaggccgaaccgtcaggccttcatcgtccccgtacgcacgtaccgctcgtgccacgacagcgcctcggcgagcaggtgcggcgtgtgcttgccgaagctttcgcgcgacgcacgctcgaagtaatcctcgagcatcggccggtagtcgggatgcgcgcaggtcgcgatgaccttgcgtgcacgctgcttcggcgacaggccgcgcaggtcggcaaggccctgctcggtgacgaccaccgcgacatcgtgctcggtatggtcgacgtggctcgccatcggcacgatccgcgaaatcgcgccgcccttcgcggtactcgccgacatgaagcacgacaggtagccgttgcgcgcgaagtcgcccgagccgccgatgccgttctggatcttcgtgcccatcacgtgcgtcgagttcacgttgccgtagatgtcggcctcgatcatcccgttcatcgcgatgcagccgagacggcgcacgagttccggatggttgctgatctcctgcgggcgcagcacgatcttctcgcggaacgtcgcgatttcgtcggcgaagcgctgcacggcggccgggctcagcgacagcgcggtggccgatgcgaagctcagcgtgccgtcctggagcaggtcgagcatgccgtcctggatcacttcggtgtacgcggtcaggttcgagaaaccggccgagctgagctccgcgagcaccgcgttcgtgatgttgccgacgcccgactgcagcggcagcaggttttccggcaggcggccgcgcttcacttcgtggcgcaggaaatcgatcagctggtgcgcaatctgcttcgaggtggcgtccggcgcggagaacgcgttgctgcgatccggtgcatccgtctcgacgatcgcgacgatcttatcggccgggcagcgcaggtacggctcgccgatccggtcgtcgcttttcgtcagcggaatcggcttgcggtgcggcggcagcgcggtgccgtaatagacgtcgtgcatcccgtcaaggccgagcggctggcgcgagttgacttcgaggatcacgtgcttcgcgcgttcgagccacgtcttgttgttgccgatcgaggcggacggaatcagcagcccgtcctcgcggatgcccgcgacttcgacgatcgcgacatcgagatcgccgtacagcccgaaccatgcgtattgcgcgacgtggctcaggtggacgtcctggtagtcgacttcgccgccgttgatcttgtcgcgcagcgtcgggtcggactggtacggcaggcgcatcgagatgccgttggtgcgggcgagcgcgccgtcgagttccggtgcggtcgacgcgcccgtcagcacgttgatccggaagtcctcgccgcgcgcgtgcgccgcgtcgatgtgggcggcgagcgcggccggaacggccttcggatagcccgaccccgtgaagccgctcatggcgacggtcatgccgggacggatcagcgcggcggcttcgtcggcggtgcggacgagcgaacgcagggcgggagcgaggatgcgtgatgaagacatggctggattctgatgctttggtctgtcgttgacgtcgctggggtgtctcctgagcgacatgaagcccttgtggccgcgacgggcggccggcaccacaggcatggtcggagtatctcagaggcggtcgccgcgaaatgtccgccgtatgaaaaagatcgttgccggatttgccgcgtatcgaacggccgttctgtgacaggcgccccgttcaattcgaatgcacatgaaaggtgcacgaaagcatccaacacaacgaccggtcgacgatcaccaatccgcacacatcaatcgacggattttcattgcgattcatcgcctgtcgatcggcaatggtcgatgccgcatccggcgcggccaattgtcacccgatgcgggttgtcccggcctgacgcacgtcaagctcgcacgcgccgcgcgtcgcgcgccgggaagcgcgaaaaacaccgccgcaccggcctgtgaggcccgtccgcccttgacaggcgcgcgacgcgaaccacactggaatacggatcccgccgccccgttcggccgccctttcgcgtacgcgcttttggtcggccgatcgttgcaagacgcggtaacactcgctcatgtcaggacattgatcgaataaaaagcaacaaattacaattccgtatatatttcgccgatggaccaaagaaaaaccgccacacgttccgaaccgcccctgccacgcacctgggatgcgcggctcgcgcgctcgcttgtccgaccgctcgtcgacacgcccgtcaccccgaatcacctcaccaccgttcgtctgctgatcggcctcgccggcgcctggtgcctcgcgcacggcggcttcggctggagcaatgccggcgcgttcctgatcgtgctgtcgaacttcgtcgaccacaccgacggcgagctcgcccgcatcagcgggaaatccagcaagatcggtcatttttacgacctcgcggcggacgcgctcgtcacgatcgcgctgttcgtcagcatgggcctcggcatcgtcgcccagggcggccagatggccgcgtcgccggtgctgctcggcgcggtggccggcgccgccgtcgcgctgatcttcttcctgcgcatgcggatcgaatcgatcgccggcaaggccggcaccaagcaggcgttcgccggcggcttcgaaaccgaagacgtgctgtacctgctgccgctcgtgacgctcttcgacggcgtcgaaccgttcctgctcgcggcgtcgatcggcgccccgctcttcgccgcatgggtcgtgatcgactggtggcgcatcgtccggcgcggcaacgtcgcgcagaatccaactgaaatccaggcttccaaatgactcctagcacgcgcgacgactccgtgctgagcccggcacgccccgcgcctgcgcgcgtggcggccgccgatcccgatcgcaccgtggccgactgcgtcggttcgctcgacctcgaccgcctgcgcggcgactacacgcgccagggctcgttcctgtacctcgacgccttcctgccggccgacgcgcacgcgaagctcgcggcggccgcccgcgcgatgcaggccggcctgaaccgcaattacctgcccggccacaagcagggcggcagcgtcagccgccatacgatcgacgagcaggcgccgtacatcgccgagctgtatcgctcgaaggcgctcatctccttcctggagaaggtcacgggcgacaagctgatgctgtcgccggacgacgatccgcacgcgtatgcgctgtattactacacgaagcccggcgaccacatcggctggcattacgacacgtcgtactacgacggccgccgctatacgctgctgatcggcgtgatcgacgaatcgtcgtgccggctcgactacgagctgcacacgcgcaatccggacgtggccgacgaaccgggctccgtccagatcgccgacggcggcatcgtgctgttcgacggcgacaagctgcgccaccgcatcacgccgctgggccagaacgagatgcgcgtgtcgctcaccttcgaatacgtgacgaaccccggcatgcgcccgtggaagcgcttcatctcgaacatgaaggacgcgatcgcgtatttcggcttccgccaggtgttcaagcaactggcgacgcgacgcccgaccgggtcatgacacgcgccggcctgatcctgctgtccctcgggaccgcactcttcgtcgcactcctcgcctggcagggcgtcggcgcggtcgcgtccacgttcctcgcggccggctggggctcgcgctcgtcgcggcgttccacgtcgtgccgctcgtgatcgacgcgatggcgatctccgtgatgttccgccacggccagcccggcgccgaactccgcaacgcgctgcgcgcgcgctgggtcggcgaatcggtgaacagcctgctgcccgccgggcagatcggcggccccgtgctgatggtgcgccacctcgcgcagcgcggcacgcggatggccgacgcagcggccgccgtcaccgtcagcacgacgatgcaggcgctctcgcaaatggcgttcgcgctgatcggcatcgccgcgttcagcctgtacgccacgcacgaatcggtcgcgcacctgcgcacgcccgcgctgatcgccaccggcgtgctcggcgccctcgccgcgctgttctacgtcgcgcagcggcgcgggctgttcggccgcggcctgcgcctcgcgtcgaagctgctcggcccgcgcgactggtcgtcgctggcgacccgcgccgacgcgatcgacgacgcggtcggcgcgctgtaccgcgatcgtgcgaaggtcgcgaagacgttcgcattgagtctcgtcggctggatcgtcggcaccgcggaagtgtggctcgcgctgcacttcctcgggcacccggtaagctggctcgacgcgctgctgctcgagagcgtcggccaggccattcgtggcgcggccttcgcgatcccgggctcgctcggcgcgcaggaaggcggctacctgctgctcgcgccgctggtcggactgccgcccgacgcggcgctcgcgctgtcgctcgcgaagcgcgcgcgcgaactcgcgctcggcctgcccggcctgctctatctgcatttcagtgaaagaaactggcagcggcgccgtgcgccgcagccgctcgccgactgatcgttcagatccgccggctttttggttggagaacccatgcgagccatcattcttgcggcaggcctcggcttgcgcctgcaacaaccgcccgaggcacagttcccgaagtgcctgctgcgcttcgacgacgtgtcgctgctcgagcgccatctgcgcgtgctcgatgccgcgggcgtcgacgaaatcgtgctcgggctcggcttccaggccgggaaggtcgagcaggaattgaagcgcctcggccgccaggccgagatcgtgatcaacgaacgctacgacctcggcagcgtgctgaccgtgcataccgtcgccgacgcgatgacgcgcggcggcgacgtgctgctgatggacgccgacgtgctgtatgacgagaacatcctgcacgcgctggtggccgatgccgacaaggcggtcgatcgcctgttgatcgaccgcgacttcgaggccggcgacgaacccgtcaagctgtgcctgaagaacggcgtgccggtcgagctgcgcaagcagctcgcggtcgacctcgaatacgacacgatcggcgaatcggtcggcttcttccgcttcaccgaaggcaccgcgcgccgcctcgcgacgatcgtcgcgggctacgtcgacagcggccgcgcgaacatgccgcacgaggaagccgtgcgcgacctgctgctcgaaggcggtcattcgttcgacgtcgccgacgtcaccggctcgccgtggatcgagatcgacttcccgaacgacgtcgcccgcgccacccaagaaatcctcccctgattcaacgcaccaccgcaggagtcgcacgatgaacgcacgcgaacccaacttcaccgaatcgcgcagcgcccgcctgcgccgcatgctcgtcagcagcgacctcgaattcctgatggaagcgcacaacggcctgtccgcacggatcgtccgcgaagccggcttcaagggcatctgggcatcgggcctcgcaatctccgcgcagttcggcgtgcgcgacaacaacgaagcgagctggacgcaggtcgtcgacgtgctcgaattcatggccgacgcgagcgacctgccgatcctgctcgacggcgacaccggctacggcaacttcaacaacgtgcgccgcctcgtaaagaagctcgagcagcgcggcatcgccggcgtctgtatcgaggacaagcagttcccgaagaccaacagcttcatcggcggcgagcgccagccgctcgcggaaatcgacgagttctgcggcaagatcaaggccggcaaggattcgcagaccgatcccgacttctcgatcgtcgcgcgtgtcgaagcgctgatcgcaggctggggatggacgaggcactgcgtcgcgcgaacgcgtacgcggaagccggcgccgacgcgatcctgatccacagcaagctgtcgcgcccggacgagatcctgcagttcgcgcgcgaatggagcggcaaggcgccgctcgtgatcgtgccgaccaagtactacagcacgccgaccgacgtgttccgccaggccggcatcagcaccgtgatctgggcaaaccacctgatccgcgcgtcggcgtccgcgatgcaggcgaccgcgcgcgagatccacgagagcgaaacgctgatcaacgtcgaggaccgcgtggcatcggtcaacgagatcttccgcctgcaggacgccgacgagtactcggcggccgagcgcatctacctgtcgtcgtcgtcgcgcgcgtcgaacgcagcgatcgtgctcgccgcgagccgcggcaagggcctcgaagccgtgaccgaagacaagccgaaggtcatgctgccggtcgccggcaagccgctgctgcgctggctcgtcgacggcttcaagacgcacggcgtgaacgacatcaccgtggtcggcggctatcgcgccgacgcgatcgacacgtcgggcatcaagctcgtggtcaacgaacgccatgcgcagacgggcgaactcgcgtcgctcgcatgtgcggccgaacgcctgaccggcgacaccgtgatctcgtacggcgacctgctgttccgcagctacatcgtgcgcgacctcgcggagagcgaggccgagttcagcgtggtggtcgattcgtcgctgacggaaaccaaccagagcgtgcgcgatttcgcgctgtgctcggcggcggacgatcgcggcctgttcggccagaagacctacctgcaacgcgtatcgagcgacgtcgccacgggcacgccgcacggccgctggatcggcctgctgaacgtgcgcggtgccggtgtcgagcgcctgaaggcgatgctcgcgacgctgcaggcgcgcgacgatttcgacacgctcgacatcccgtcgctgctcaacgaactgatcgccgccggcgagaagatcgaggtgcagtacgtgcacggccactggcgcggtgtgaacgatctcgaagacttccgccgcgcgggcgacttcgcgcacggccagacgccgctgtccgaaccgggcaccggcaacgggggcgcgcaatgatcgacgcggcacagttcgtcgaggccgcgcgcgagcgcggtttcgactggtacgcgggtgtgccctgctcgtacctgacgccgttcatcaattacgtgctgcaggacccgacgctgaattacgtgtcggccgcgaacgaaggcgacgcggtcgcgctgatcgcgggcgcgacgctcggcggcaagcgcggcatcgcgatgatgcagaactcggggctcggcaacgcggtgagcccgctcacgtcgctgacctggacgttccgcctgccgcagttgctgatcgtcacgtggcgcgggcagccgggtgtatccgacgagccgcagcacgcgctgatgggcccgatcacgcccgcgatgctcgacacgatggagatcccgtgggagacgttcccgaccgaccccgaacaggtcggcccggcactcgaccgcgcgatcgcgcacatggacgcgacgggccgcccgtacgcgctcgtgatgcagaaaggcagcgtcgcgccgtatgagctgaaggcgaacccggcagccaggccgcgcacgcatgtcgtcgcgcaatcgtcgtcgcgcgccgcgtcggccgaagcctggccgagccgccaggacgcgctgcagcgcgtgatcgcgcacacgccggtcgattcgaccgtcgtgcttgcatcgaccggcttctgcggccgcgaactctacgcgatcgacgatcgcccgaaccagttgtacatggtcggttcgatgggctgcgtgacgccgctcgcgctcggcctcgcgctcgcgcgacccgacctgaaggtcgttgcggtcgacggcgacggcgccgcgctgatgcgcatgggcgcgttcgcgacgctcggcacctacggcccggcgaacctcacgcacgtgctgctcgacaacggcgcgcacgaatcgacgggcggccaggcaacggtgtcgcagcacgtgtcgttcgcgggtgtcgcggcggcgtgcggctacgcgtcggcggtcgaaggcgacacgctcgacgtgctcgatacggcgctggccgcgtcaagcgacggtgcgcagttcgtgcgcctggcgatccgcaccggcgtgcccgacggcctgccccgcccgaccgtcacgccggtcgaggtcaagacccgtctgatgcggcacatcggcgccgcgcagaccgaagcccacgttgaaggagcccattgatgctgctgctgaaccccggcccggtcacgctcaccgaacgcgtacgccgcagcctgctgcaacccgacctgtgccatcgcgaaagcgaattcttcgatctgcaggacgaagcacgtgcgcgcctcgttgccgcgtacgagctcgatccggccgaatggaccgccgcgctgatgacgggttcgggcacggccgccgtggaaagcatgatcgcggccctcgtgccgcaggacggcaagctgctggtgatcgagaacggcgtgtacggcgagcggatcacgcagatcgcggcgcagtacgggatcgcgcatgacgtgctgaagcatgagtggatgcaggcgcccgatctcgcgcagatcgccgcacggctcgatgcgggtgggtactcgcacgtcgccgtgattcatcacgagacgacgacgggccggctgaacgatctcggcgcgattgccggggtgtgccgtgcgcgtggtgtgaagatgcttgtcgatggtgtcagcagttttggggctgaggcgatcgacttcgccggcggcgacatcgacgcggttgccgccaccgcgaacaagtgcctgcacggcgtgccgggcgcggcgttcgtgatcgtgcgccgcagcgcgctcgcgaaggctgcaagccgcacttactacctcgatctcggtcgcctggcaaagctgcaggatcagcgaaatacgccgttcacgccttccgtgcacgcgtattacgcgctcgtcgaggcgctgcgcgagtttgatgaggctggcggctggcgtgcgcgtcatgcgcattacaaggcgctcgccgatcaggcgcaggctgggctggcagcgcgcgggatgccgctcgtgctgccggaaggtgaatcgtcggtcgtgctgcgcgcgtaccggctgccgcagggtgtgacgtacgagacgttgcatgacggcttgaaggcgcgtggtttcgtgatctacgcggggcaaggcgggctgtcgaaggaactgttccggatttcgacgatgggcgcgattcaggcggctgatgtcgatcggttgctggaagggttcacggcgctgacgcggtaagtgtcgctcgtaccttcgtccatgaaaggcccttctcggaagggcctttttattctttgcggatttttcggaaactccggacggttgagcccgcagccattatcagtcactcgacatgaccgagtcgttcgttgacaatcggcttttacaaagttgaccgcgcttgtttaaagcaagccaacgatatgtgcttcagtcggcgctgtcgaccacgatcgacgccagaattactccgatcgccacatgaatgaaaaacagcagtgggagcaagaatgcatatccacgcatcggcatccggccgtcgttgcgcagcgctcggggtcgccatggcgctgacattttcgtggttcacctctgcacaggcacagagttgcgtgcctgacagcgtggcgcccgagtgcttgctgcagcgtagtcaagacgaatttcagcaagcggacgacgagttgaaccgcacttaccaaaaggttttgaagtcgatgtctcggccgcgtgacgagtacgtcgactatccggcactcaagacgaaattcgtcgaggctcagcgtcaatgggtccgttttctcgataaagagtgtgccgcttggtatctgataaacgaggcaggcgcggatcgtaatcttgatctactgacttgcgaaatcgacagaacacgtgatcggacgcgtgaattgaatgcgtggctcaagcaattgagccatgattagcgcagcgccagatgaagacggcatcaccaggtcgacggatattagagagggtttcgctcaacgaaccaaaaagcgccgaccgcgacgccctcgccctgggcgcttcttgtcagctactccgccgggcatatcgggcagtttccggtcaggagcggccgccaatttccgcctgtactgcatcaaaccaccgccagtttgagccattcgacgcagctacggaatgggtcgctccatgactatcagctcgccgagaaatcgctgattggtcgcccgtctgatttcctcgaatccctcgcgctgccaaaatgcgaacgcacgcggattcgttgaaacgaccgcgagttgcgccctgcggaagccccactcacgcgccatagcatcgagcaacgccaacgcagtctttccgtaaccacgacgctggtacgcatcggaaaataacagcagtccgatccagatgcagtcgtcagttggatatgcgcgaatcacgtcggcacagccaaccatgtctggcccgacgtaaaagccgaagactgatttatctccccatctttgcctgcaggcttgccgtagaagaaatcatcaacatcttctttggagggtgaccgtccttcgaccagttgagtataagaggcggcttcgataaagacgcgcgatacgttcgcgtaatcgttatccgaatcgccgccgagtgcgcggactgtgaccatcaggcgctctttcgaagtgtgaggcgtaattctaagtcgatttacccatgaacacacgcagcgcaacatggcgctagcgtccgcttcatgggaagttgagtgtctcttccggtctggttcggccgaccgcatcaggcggcggtcggccattttgagatgctcgacgccgccgattaaactgttggcaatcatcttcccagacacgcaccgatcagcatgagcgcaatcaaactgttgagacctacgaccgccttgctgccgagctacgttgcggcgcttgaggcaggatggtcgcccgacaacgtccgtaaggagatcgctgcgcgcgaacaattggacgctattgacgtagatgctgagcgattcgtggacggactggacgatccaactgcatcgggcggtctgattcccttacccgatggctcgactgtcgcgcggctcccgagcattgtccgctggatatgggacggtgatttcagcggcgcaatcggatttcgttggcaggccggaaccgccgaattgccgtcgtacgtactcggacatatcggtttctcggtcgtgccgtggaagaggggcaacggctatgccacgcaggcgctcgatttgatgctgggcgaagcaaagggagaaggcctgccctatgtcgaactaacagttgatccggagaatatcgcctcgcagagggtaatcgctgcgtgcaatggcgtattgatcgagcgcttcagaaagccggcagcctacggattcgctgagacgctccgctatcgcattgaattgaacgactgagcaagctgtcagcccttattcggccgctttctgccgctcgtctgagccatgtagtgatgcgttgcatcgacgggttgaatccgccgtcggtaagcgacatccacgacatccatgaagaacctctttccatcatgaccgtgagaatccttcatttcgccccgttgctggcgctcgccgcctccccatcgttcacgccgccgacagccagccttgcgacgacgacactgtcactgccgtcgcccgctgggccggcatcgcgagcgcccgcatcgccacacgtgacgcggaccggctcgtcgtcgcggcggcctgcaaggtcatgccgaatgcgcccggaacgacgatcgcggccgtcgcgttcgattcgctgccgaaaagcaggaacccggacgaaagcagcaagttgcaggtcgtcgcgctcgttgaaggcggcaaggttgttgcggccgaaaaatcgctgatcgaagaagatgccgcgacggaggtcggcgagaacagctatcgcatcgacacggcaccctaccggctgtcgcccgatgtgcgggcgtttggtgtcgtgttcagcagcaccgcgcacggaccgagctgcccggatgcctacatggagaacgaactgaccctgtggattcgcgaaggcgctcgcatccgccccgtgtttggcaccaatctcaatggctgggtcgctaccacaggtaccgcgtgcggccccgataccagtgacctgcgcagcgagtccgcccgcatgacgattgcggtcgagaagacgtcgcacaacggctttgcggacctgtcgattacggcacacgtgatgaacgcggaaagcaacgacgacaaacaaccggacgcgggaaaacgcaccgtgcgcacggtcgtcaaatacgacggcaaatcatacgggagcgatatgtaccgggacttctggtattcgcctgcctcaaagaagcgattcaaataacggtaagcggggccgcagtaacaccgccccacccatctactccaccaccttcgccccgatcgcctcgcccgacgccggcctgagccgcgcttcctcccgcccccgccgcatctcgcgcgccgtataccgatccttcagccgcaggaacggtttctcgacaaggaaataactggccgtcgccgccatcagcgcccacacgatcccaagcggaaacgcatgcgcaaccggcagatccggattcgcgaacggctgctgccacagatagaggctgaacgagatcgtgccgacgaacacgacaggctgcgcacgcaaccatcgcgcacaccagaattcgctgcggaaattcagcacgacgatcacgatcgcgatcagcgccgcctcgagcgtcacgccgtacgtcgcgttccagaagccaccgaaccggtgttcggcgagcgggccgccgatcagcacgaccacgatgatcgccgtcacgatgcgcgtcccgccgcgccacgagcgaatccacgcttcgagccgttcgcggttgagcgacgcataacaaccgatcaggatcggatcgacgcccgtgtgaagcatcatcccgagctgcccgcgcagcgcgggcgccacgaagtacgtgacggcgcgcacgagcggcacgaccaggatcagcgcggccagccagcgcgtcccgccgcggcgcatgccgtacacgaacagcagcggccagaaccagtagaactgttcctcgagcgcgagcgaccagaaatggccgagataccacgcaccgtcgggatgcaacgtgttgtcgccggtcagcccgaaccacgccgagtagttccacaggtgcagcgccgcatacagccactgccggcggtcgacgtcgaaccagccggcaaacgccacgatcgcgaccgccgcgagatagacgtagcaggccggccagatccgcagcgcgcgacgcacgtagaacgacgtcagcgcgatgccgcccgtgcgcgcgaattcggcgcgcaacacgttggtgatcaggaagccgctgaggacgaagaagatcagcacaccgagccggccgtcggcgatcagtcgcaacggcgcgtaccagcccgtgtagccgccgggcagcacgtgctcggcgtgtccgaccacgaccatcgccaccgcgacggcgcgcaatccggtcaactgcgtgacgcgatggttcatcggctggtttccgtcggcacggtggatgggcagcagaccggcgctgccccgcttcggcacgccgatatgccgccgggattttgtatgaaaaatatccgaatgaaattacttcaaaaatcccgcccccaatacaagccgccccggctggacgtccggggcgggctgcgcagcgccggccgcctgctgcggcgcaacgatcaacgggacgcggcaagatcgcggcggcgcgttcaccggtcggctttcttctccagcagccggacgttctgctgcgcgacctggagatcctgcagccgatccaccagttccgcgcagcccgtcttgtccatctggaacggcgtgccgcacatcgggcagcggacctcgctgttgccgagaaaatccgccagcgacaacttcacccgcccgcgcgtgcagaccgggcacatgaaacccggtgcgtcgttcagcatcttctcgctcgtcttcatgactccctcctggagtgatcgccaccttcaccggtggcctgggtgcccgcgccgccgacctgggtattcatgcccagcagcgccagcaggttgccgataccggccgggatgccggcctgcccgacctcgaccttcgcgccgatgttcgcctcgagaaacggcgacacgtcctcgcgcgtctggccgccggcctcgggccggccgcgtgcgagcatggcgctccagcgatactggcgcggcgcggcatcgtccgcatcgccgggcagcagcgggatcgcgcacgacgccttcacgcgctcggcaagcagcaggcgcacgccgaaatcgaatgtcgcggtcttcacttcgagcagcggcagcgggatcaatgacagcaccggaacctgcacgcggcgccattcggtcttgtccttgccgagcacctgttcgtagaagaacgtgatcatccgcagttcgccgaagtcgctgtcgtccagctccctcggctcgcagccggtggacggcttccgcacgaagccgaactcgcggacgtaccggacgaactggcgcgcagccatgaagtccgcctcgatcacggcctcgatcggcgcagcgaacaggtactgcagatcgacgacggggctgatggaatcggtcatggcatcactccgtgacaaccagttcgtcgcgctcgcggccgccttcgccgacgagcacccacttgtagttgcgcagcttcgcgcgcagcgtcagcgtctgcacgaattcggatggaataccctgcagcgcggccgggtccagcgtcaccgcgagcgacggcacgcgcgcggtctccgcctggatcccgcgctgccgctcggccgccgcttcgatcagcccgcgcagctcgtcccagctcgcgtcgactgtcccctcgaacgacgtatgtcccgcatccgcgcgctcgtgcgcgtcgaacacgtccgccaggccgtcgtccagtgatgcgtgaagcacgtcgagcaggcccgcacgcagcgcatcgcgcgtcggcggcgtgccgcgcatggcctgcgtcagtgcgtcgccgagcaacgcgtgcaggttgccgcccagctcgcgcacgacgcgggacgaacgcaacgcgtcgatccggtcgtgcgccgggtcggcgcccccaccggccgcaccgcgcgcgcgcgcacgcggccgagcgcgccggcgagatcgcgcagcagcagtgcgcctgcctccgtcgccaggtcggcgacggcgacctgcgacggcagcgcatcggccgccagcgtgtccgcgtcgagccgcgatgcccgttcatcgccatcggcgcccggcggcaccgcgaagcgcagcgtcacgtccgcttcgtcgagcaggccgttcggcaccggaaaatacttgagtaacggatcctcgcgatacttcacggcgaggcgcttcgaatacaggttcgcttcgtgctgcgcgcccgcgagactgtcgaggaacgcggcggcgatatcccgcagattggtcatcggtgttctcctctaacccgcgccggcaggccggcgcgggcgggttgtcacatcggacggatcagggcttggcctgcagcgtgaggctcgtggacacgcccgcgccgtcgatggtcgcgctgacggtcacgaccgacttgctggtgtcgtcgagcgccttgcaatcgatctcgaccttgccgttggcgtcggtcttcggcggcggatcggctttcacgctgtcgccgttcgcggtgacctcgaaccccgcaccgcctgcgtcgaacgcgaacttcagctcgacacccactgccggcgtgccgtccggtttaagcgcggtcagcacgtccttgccggagtctccttggcaatcgagagcgtcgcctgcgcgctcttgagtgacggcgccgacggcggcggcagccggtgcagcacgcgcaccggcacgacaaccgacttcgcatcgaccttgccgctgtccggcgcggggatcgacgcggacaccgtcaggtcgatcgcctgcgcgtcgacctcgccttccgcccagaacaggacggacaacgaaccgtcgccgtcggtcttgaacgacgtgaccttgccggctgcatcgaacgggatggtcgaaccgaacggcgcgcggctcatccggaacttgtccgcgagcgcgggatcgatctggaacgcgacttccgtattgccggcgaacagcccgctcgaattctgcaggcgcacctgcagcatctgctgctgtgacggatcgcccgacatcacggtcgacaacgccggactgacctgcatgtcaccgttgcggctcgcgccggtcgcggcgctcgacaggatgttgagcacggtcgcgagcccggccggcacgccggcctgcgacgcatgcacgaacacgtcctgcgtgtactcgaccgaatagcgcgagtcctgcgtcgccttcgaatccttcttgctcgaatagctggccttcatctgcgccgacaggctgaacggccccagccgatcttgccctgcgccgacagttcgcccgcgatcgcttcggacttcgactcttccgacgtcgacgacgccgccgcgttgatgttcgccttgaactggatcgtcacttcgtcgaccaggatcagcggcaccggcacgatcgtcagcagcggcacgatcagcttcaccatctgcccgtccttctggtacaggaaggtgacgttgacggcctgcttcacgccgtcggtgtcggtcgtgaggccgaccttgtcgatgaactcgtaggtggatttcgcggccatcgcctgcgcggtgatcgcggcctgcaacgggccgccgatcagggcgctgtagtcgataccgttcaacagactccgggcggactcggccgccgaattgtcaactggcatgattgatctcctgtgatttcggttccgcacgcgccgccgtgctgtctcgccggcgcgtgcggtacgtcatgcggccgccggccctcggcgggcggcggccgggccggcggttacgggcgcggcggcgggcgcaggcggaaacgcatgcggtttgcggaaagctccgcatccacgctgtagcgccgccagatcgcgaaaccggtcagcagcgcgaacgtgctgacggtcgtgaccaccacaccgccgtagatcgcggcgttcggcacgggacgaaacggccaggtgaacagcgcggtgtccccttccgcgtgatcgtcggcggcccgaggttcgagcagcttcgtccactccttgacctgctgtgcgtcggtgacgtcgaccaggatctcccggcggatcgattgacgagttgcgccacttcgacctgtgtggcgcgatcgtccttccagacaatcacattttcgctttccatttttcactccttttcattaagaaaaccgggtgaattcgccctcggaatatcgcgcattctcccgtccgcgggcgaatgcaacgcaatatccgcccgccattcaaattgcgccgaatgcgaatgccgctcaatacctccgattgcgtagtgaaaagcgaatcgccggaatcacaattcgcggccgattttcatcaggcgggcaagttcgtgaatggacaatttgtgcatgatgttttcacgatgcttgctgaccgtgcgcgggctgacatcgagcaaccttgcgatttccttgctcgcgagaccggcaccgatcaggcgcagcacatcccgctcacgcggcccgagcgcggcgatcttcgcaaggagagaggtcgtccgcgagcggcggcgcgtgttcgaccgcatacgcgacgagttgcgcggtgcccgtcaacccgagcttacgcacgatgttcgagcgatgcttgcgcaccgtcatcggcgcggcccccaatgcctcggcaatttccgtacagcgcatccccgcgcgatcaacgacacgatctcgcgctccttcctcgtcagagaatcgctaaccattcacaatccccggaattattttgatttctcgttgattcgcgacgcatggccagcgtcatgagtgcatttcatgcgtggcacgcgcatgaaacacaacgacatattgaatcggaatgcgtgaatgatgcgatgcgtttttacggatttttcaatgccgatcgacaggaacgacagccgtgcggcatgccggaaccgaagcgcgccatttcggcgagttgggcataatggcgtactgctttcggcaccggttgcccggcaccccaccgacctttcaatcaggaaacgtcatgtacccaccgatcgaaccctacgcccacggccatctcgacaccggcgacggccaccgcatctactgggagcgctgcggcaacccgccggcaagcccgccgtgttcctgcacggcggcccgggcgccggctgcagcgccgaccatcgccgcctgttcgatccggagcgctacgacatcctgctgttcgaccagcgcggctgcgggcgttcgacgccgcatgcgagcctcgagaacaacacgacgtggcatctggttgccgacatcgagcgcctgcgcgagatggtcggcgcggaaaagtggctcgtgttcggcggctcgtggggcagcacgctgtcgatcgcatatgcggaaacgcacccggagcgcgtgagcgcgctggtcgtgcgcggcatcttcacgatacgccgcgcggaagtgctgtggtactaccaggaaggcgcgtcgtggctgttccccgacctgtgggaagccttccttgcaccgattcccgaagccgagcgcggcgacctgatcgccgcctaccatcgccggctgaccggcaacgacgaagccgcgaagctcgaagccgcgcgcgcctggagcatctgggaaggccgcacgatcacgctgctgcccgaccccgcactcgccgcgcacttcgcggacggccactacgcactcgcgttcgcgcggatcgagaatcattacttcgtgaaccagggtttcgtcgaggaaggccagctgctgcgtgacgcgcatcgcctcgccggcattccgggcgtgatcgtgcagggccgctatgacgtcgcgacgcctgctcgcaccgcatgggagctgtcgaaggcctggccggatgcgacgttcgagatcgtgcccggcgccgggcatgcgtacaacgaaccggggatcctggaggcgctgatcgcggccacggaccggttcgcgaactaaggcgcgccatcgggcaacgccgcgcgcgcgattgatccgcgtcgagcctccagccattgcgcgagccggatgtctgccggccgggaagttggaggccgttccgtcatcgcgagtcgctgcggtttgccggatggcacgcacaccggccactcttccacttcgaaggctgattcatggcgttgacaccgaccgaaccccgttccgagcgtctcgaccgcccttcggtcaagtcgcttgccgtccgcgtgaacggcttgcgcattcacacgaaagtggccggagccggccgggccgtcgtgctgctgcacggctggccgcaaacgtcgcatgcgtggcgaaagctcgtgccgttgctttcgcctcactgcatggtcatcgcccccgacctgcgcggattcggccactccagcaagcccgcggcaggctatgacaagaagaccgtcgcaggcgacatcgccgcgttgctgcatgcgctgcagatcgaaaaggcctgcatcgtcggacacgacatgggcggccaggtgggctacgcgttcgcggcgctgtatccgcaactcacggagcggttcgtgttcatcgagagcggcttgccgggcttcggccaggaaaaggcgatgaatgtggccacgggcggcagttggcacttcggcttcaatatggcggggacatttcggaagagctggtccgcggccgtgaagcactgttcgtgcgtcacttcatccggcgcgacacggtaggcaccgtcgatcccgagtccatcaccgaagcggacatcgacgtctacgcgaccgcgctcacgcagcccggcgcccttcgtgcgagcttcagctactaccgcaccctgttcgttgatctcgacgacaacaagacgttcggcgcgaagaaactcgacatgcctgtcctcgccatcggatgcgaattcgggtacggcgaaggatcgaaggccaccatggcgcaggtcgcgtccgatgtgcacgggatcgtgctgcgcgactccggccactatcccgccgaagagcagccggaacagcttgcgtccgtccttctcgactttctcgcccgatgatgtccgccggttgccgacgatcgccggaagtcgcagggatgtgccgtcagcagcttgatcctgcccaggggttcacagcgcggtttcgacgatcgccctgccgctgatcgcccgctcgacgagctgctcgtcgccgaccttgcggatcgcgtcgtcgagcagcccctccggcgcctcggtcgccaccttcagcaagcccgacaggccgcgcgcgtcgagcaccaccagcgtctccatcgaatccgcacggctcacgagcacgcggcgccacgccggccccgcgccgaagctcgcacaaagcgcaatcgtctcgctgccgagcgtgtagtcgaaggtcttgatcatgatccgccgccgttgcaagggaatggcgctgcgcgtcggtgcggcgccgtgatgtcgacgcacccgcgcgtgccgccggcgtccgaatcaagccagatccgttcgccggcatggccatgctaggcgtgcagtattaacgaagacttaaaccgcaatgcgcgcgggcacgcggcatcgcgcgacattacggcgtgtcgagcggctccaccgtcacgccgaccttcagctcctgatccgcaccgccgccacggatcacaccgcgcaacggcgtcacgtccgcgtagtcgcggccgatcgacagcatcacgtagtcgtcgcccggcgcgcgatcgttggtcggatcgagctgcagccagccgttgtcctcgggccatgccgggtcgtacacctcgacccacgcatgcgacgcatcggcgccgatcagccgcggctgcccgggggcggctgcgtcagcaggtagccgctcacgtaacgcgcggccagcccgagcgagcgcagcccgccgatcatcacgtgcgcgaaatcctggcacacgcccttgcgcaagcgcagcgcatcgagcgccgacgtcgtgatgtcggtactgttcggcggcctcgcgaaatcggcatgcacgcgccgcatcaggtcccaggcagcctgcacgagcggccgttgcggcgtgaagctcgcggccgcatacgcggcgagttcggcgtcgcacgtgacatgcggcgacgtgaacacgaattcgctcgcggcatcgtaaggctgccctgcgcgaaaccgcaggcggtcgcgcacggcttcccacgcagtcgcctgtttcgcgtcgggatgcgcgatggcgggcggcggcgcgccgcgcgcaccgcgcgaccacacgggcggcgtcacgcgtaccgtgctgcggctgcgcacgagcagcgcgtcatgtggcaggttcaacgcgaacgatgcgcgcgcgttgccgaatgcatcgatctcggtacagaccgattccggctcgggatcgatgtcgagcgcgaacgaaagcacttgctggcgcggcgtctcgagcggttgcagccgtgcctggtgctgcgccgattcgacgcgcgccgcgtaacggtattcggtgtcgtgcgtgacgcgcagcaagcggcccggcgcgacgtcggcggtcgttgctttcgcggccgatgccgctgccgatgccgatgcgttccgggcatcgccggaacccggcggggctttcccgcgcctttcgtcgtcaccataacgtcctgcccgcctcgcgtacgtggctgaaatagcgctcgccgatccggttcgacagttcccagaccgccttcgccgtcgtgtcgagcgcttcgagcagcgcgccgtgccggccaccgtcggtggtttcgcacagctcgtgcagcgaccacgcgggcacgtccggaatcgtctcggccagttcggacagcgcataaccttcgctgcgctcgaccttcgtcagccggccccgcagcgcctgcacgacccagccgagcgagcgcggattgtcggtatcgagcacgacgagcgacagcagcggcgcgacatcgaagccgcgctggaaacgcgaacggaacgtgatcgtgctgtcgaacagctccagcacgagctcgaagccgtcctgccggtgcaccgcgccttcgtcgaacgcgcacttcagcacgctgcacaggaagtccagccggtcgatctgccggccgatcgacagcagccgccagccgtcgtcgcgcgtcatgttgtcggtctgcgcgcccgtgatcgcgccgagcagcaggccgaggcgctccagcaactgcagcgcgtcgttgccgatctgttcctcggcttccggctggcccgcgctgtccgcgaacagctgggtcgcgtcgtcgatcaggcgccactggtcgctcgacagccgttcgcggatcgcggcagccgcgccacgcatcccgaacaggcacgacgcaatgcccgacgtgcgatccgcgccgcgcgtcagcgacgtcgcgagcgcgtgctggaacgcacgcggcgcatcgacggcgttcggtgcatcggccgcgatcaggcccgtgtcgcgacacagcgtgtcgagcagttccaggtgcgcggggctgtcgacgtcgtcctcgccgcgcagccgttcgagcgccgcgcgcgagccgcatcaggttggtcgcgcgctcggtgtaacggcccagccagaacaggttctcggccgcgcggctcgcgatcgcgcgcggccgttcgacgaggtcgtcggggccgagatgcgtctgcagcagcgtcgtcgaatcgacgatgccttcggtcatcacccatgtatcgacagtgctgccgccgcgcggcatcggcgcattgaacagcgtgtcgcgcgtgccgacccgtgacagcccgcccggcaggagccgccagcgctgcgcaccgtcggcgagcgcgaagacgcgcagcagcaccggcttcggcacgatgcgcgcgccgccgtggccgtcgggcgcgtcctgacgcggccaggtcggcgcctgcgacagcggcaggtcggcctgcaccgtgtagtgttcgggccgcgcgaggatgcgtgcgcgccattcggccagctgcgcctgcgtgagccgcgcgccgatcaccggctcgagcgggccgccgggctgcacgtcgggtggataggatgccttcacgatggcgcgcgcgagttgcggcaacgcgtcgtcgcacgcggccgcctcgccgcaccaccacgaatgcacggccggcagcgtcagcgtttcgccgagcagcccttccgcgagacgcggcatgaagccgagcatcgccggcgattcgaggaagcccgagcccggcgcgttcgcgagcagcacgttgcccgcgcgcacggcctgcagcagccccggcacgccgagcatcgaatcgggccgcagttcgagcggatcgagccacgcgtcgtcgacacgccgcaggatgccgtgcacgggttcgaggccgctcagcgtcttcaggaatacgcggttgtcgcgcgcggtcaggtcgccgccttcgacgagcgtgaggccgaggtagcgcgcgagatacgcgtgctcgaaatacgtcgcgctgtgcggccccggcgtcagcagcacgatccgcgagttcttgcgggccgggctgagcgcctgcatgctctgcagcagcgcgcggtacgcggacgcgagccgctgcacgcgcagcccgcgaaacccgcgcggaaagagccgcgacacgatcagccggttttcgagcaggtaaccgaggccggccgcgccctgcgtgtgctgcgcgacgatccgccactgcccgtccgggccacgcgcgagatcgaacgcgaccacgtgcagccaggtgtcgcccggcacgctcgcgccgcgcatcgcgcgcaggtagccggggtgcccggtgacgagcgcgggcggcagcagcccgcgctcgaggatcgtctgcggcccgtacaggtcggccagcgtcgcgttgagcagccgcacgcgctggagcacgccgcgctcgatcgcgacccagtcctcgggcgtgacgatcagcggcagcaggtcgagcgaccacgggccggccgcaccgtcgccggcgcgctgctcgtgcagttggtagaacaggccgttctcgcgcatgcgccggtgcagcgcgtcggcgcggcgatcgaggtcggccacgccgtcgctgccgatcgatgtgaagaaactgcgccacgcgggcgcgagcgcaggcgcgttcaggccggccgcgctgccgcgcagttcgtcgtagcggccggcggccgccggcgccgcgagcgcggcggccagttccgcggcatccggctgcgcgccggtatcgaaaagcgtgggcatcgcgtcgagggcggcgagatggtcgatgtttatgggcggcacggtgtcgttccgtcgtcagggcgcggccgcgcacgcgcgccgccgcgccggcggcgatacgcggcgtgcggccgcaatctgcccgcatcctagcattccggcggggccgccatcaccccattcgccgggagaccgcacgccgcgcatcgtcgtccgcctcgtcatcgtccggtcacggccgccgcaggtcgagcgtgaacgggaattcgcggctcggcgcggcaggcgcgacctccatccgccccggcgtatgccccatctcgacgaagcgtgcgagccggcggctctctgcttcgtaggcattgaccgggaacgtcgcatagttgcgtccgcccggatgcgcgacgtgatagcggcagccgccgagcgagcgctgcaaccacgtatcgacgatgtcgaacgtgagcggcgcgtgcacgccgatggtcggatgcagcgcggacggcggcgaccacgccttgtagcgcaccccgcgacgtattcgccgacggtgccggtcggctgcagcggcaacgcgcggccgttgacggtcacgacgtggcggttgtcgttcagccccgtcacgcgcacttcgagccgttcgaccgacgaatcgacgtagcgcaccgtgccgccgggcgcaccctcctcgcccatcacgtgccacggttccagcgcgccgcgcagcgacaactgcatgccgttcaccgcgatctggccgaacagcgggaagcggaattcgaagtgcggcgcgaaccacgccggatcgaacgcgaaaccggcgtcgcgcagctcggccagcacgtcgtcgaaatccatctgaagaaactcgggcagcatgaagcggtcgtgcagcgcggtgccccagcgcgtgagcggcgtcgtgtacggcgcggcccagaaacgcgcgaccagcgcgcgcagcaacagttgctgcacgatgctcatccgtgcatgcggcggcatctcgaacgcacgcagttcgagcaggccgagccggccggtcgacgaatcgggtgaatacagcttgtcgatacagaattcgctgcggtgcgtgttgcccgtcacgtcgatcagcaggttgcgcagcacgcggtcgaccagccaaggcggcatgtcctgcccgaacagcagcttgttgcgctggatctcggcgaacgcgatgtcgagctcgtagagctggtcgttgcgcgcctcgtcgacgcgcggcgcctggctcgtcggcccgatgaacagcccggagaacaggtaggacagcgacggatggttgtgccagtacgcgatcaggctcgcgagcaggtccgggcggcgcaggaacgggctgtcggccggcgtcgcgccaccgagcacgaagtggttgccgccgccggtgccgacgtggcggccgtcgaccatgaatttctcgctgcacagccgcgactgccacgcggcgtcgtacaggaattcggtgtggtcgacgagctcgtcgaagttggcggccgggtggatgttcacctcgatcacgccgggatcgggcgtcacctgcagcttcagccgcgcgtcgcgcggcggcggatagccctccagcacgagcttcacgcccagcgcgtgggcggtcagctcgatcgcgccgagcaggtcgagataatcctcgagcgcggcaagcggcggcatgaacaggtacaggatgccgttgcgcacttcgacgcacagcgcggtgcgcgtgatccacgcagccgattcgaagcgctcgggaacgcgacccgggtcgcgcgcggcaggccgaccgttcccggccgggccgtcgtcgcgccactgcatcacggtctgcgcggacgcctcgcgatgcacgccggacaggtagcgcggcgcatcggccggccccgcgtagcgcgcgcggatcgcggcggcttccggcagcgcgtcgcgcggcgcgaacggatcgcgctcgacgagatacggatagtcggcgcggctggcccacggcagcgaatcgagcggcagccgataacccatcggcgaatcgccgggcacgaggtacatccgctcgtcgcggaagaaccacggccccgtctgccagcgcggcccgtcgaggcccggcgcagtgtccacgcgcttgaccggcagcacgtagccgaccacgctgtcgagctgctgctcgaacaccttgcgcaaccgcgcgcgttcgagctcgtcgtcgaggcgcgagtcgaacgggtcgacgttgaccggcagccggcgctcgcgccacaggtagtaccagacgtcctcgtagccgggccggatgaattcgccggtcaggttcagccgcgcggccagcgcatcgatgaagcgcttcgcgtcgtcggtcggcctacgcggacggctcgcgctcgtcggcgaacagcgacgggtcgtgccacacgggctggccgtcggcacgccagaagatcgacagcgcccagcgcggcagcgctcgcccggataccacttgccctgcccgaaatgcaggaagccgccgtcgccgtactcggcgcgcagccgctgcacgagttcggtcgcgtagccgcgcttggtcgggccgagcgcgtcggtgttccactcggcaccgtcgcgatcgtcgatcgacacgaaggtcggctcgccgccctgcgtgagccgcacgtcgccggccgcgagtgcgccgtcgacctgcgaaccgagcgtcagcacggcgtcccattgcgaatccgtatacggcttcgtcacgcgcggcgattcgtacacgcgcgtcacggtcatctcgtgctcgaacgacacctcgcactcgtcgatcagcccctcgaccggcgcggcgctcgtcggctgcggcgtgcaggccagcggaatgtggccctcgcccgcgagcaggcccgaagtcgggtcgaagccgatccagccggcgcccggcaggtacacctcgcaccatgcgtggaggtcggtgaagtcgaccgacgtgccgctcgggccgtcgagcgacttcacgtcgggcgtgagctggatcaggtagcccgacacgaaacgcgcggcgatgccgagatggcggcacagctgcacgagcagccacgcgctgtcgcggcacgagccggacgccagctcgagcgtctgctcgggcgtctgcacgcccggctccatccgcacgagatagccgatgtcgcgctgcagttgctggttcagcgcgacgaggaagttcacggtgccggccggcgtgcgatcgacgccgtcgacgtacgcgcggaacagcggcgccgcgctcgtctgcgggtcgcacacgagatacggcgcgagctcggtcttcagcgcatcgtcatagctgaacgggtattgctccgcgctcgcctccagaaagaagtcgaacgggttgtacaccgacatctcggcgacgagatcgatcgtgatctcgaagtgctcggtgcgctccggaaacacgagccgcgcgagatagttcgagaacgggtcctgctgccagttgatgaagtgctgcgcgggctcgaccgtcatcgaatacgcgaggatcggcgtccggcagtgcggcgcgggccgcagccgcacgacctgcgggccgaggttgacgagccggtcgtagcgatagcgggtggtgtgatgcagcgcgacgtggatggacatgggagctcggttcgggttgggccggccgcgcgccgcgtcgtgttgaacgcgacgcggcggcccggcctggcggattcggcgaaaacgcgcgtcgggtcagacgagctcgggtgtctgcacgacgctgatctcgacgccgacggtcgtcgcgccgagccccgtcaccggctgcgcgtcgcgatagtcgaggccgaccgcgatgcgcacgtagcgctcgtccgggcagcgattcatgaacggatcgaacccgacccagccgagcccttcgacataggcctcggcccacgcatggccggccggctgctgcatcagcccggccgcttgcggctgcgcaccgagcgccggctgcggcagcccctgcgattgcgcggcgtgcgacgcgccgagcacctgctgcatgccctcgccgctctgcaacgcgagcgcttcttcctgctcgtcgtccccacgttctgcttcgcgtcggcgatgcgctgcatcgcgctgtccgcgagcacgtaacccgagatatagcgcgcgggaatcttcagcacgcgcgcggccgcgatgaacgcatgcgcatggtcgcggctcgtgccctcgccgctttgcagcgcggtttccgcgtcgacgggtgcgtcggcggccaggttaggcgcatacgcgatgcggtcgtgcacttccgtcatcagccagtgcaatgcgtcgaggccgcgcgggtcgatgggcagcgcttccgtgagctcgcgcacggtgtcgccggccttcgtgagcgcggtctcgcgttcgaagatccacggcggcgcatagccttcaggattaccgagaatgccggcgcggtcctgcgtctcgacgacgccggccgcgatgacgacgatctcggccttcgcgccgcgctcgtgccgcacgaggtcgatgcggttgccgagcccgtcggcgtacgacagcgacggctcgacgccgtcgatcgtgacctgccacgcgcgcaccgtctgcccggggcctgattgcgggcgcagccgcagccgttgcagcgcatgggtggcttgatcgtcgaactgataacgcgagatgtgtcgaatggcgagtcgcatggcaagtctcagtcgaagttgtaggcctgggcgatttcgatcccgaggctgttgttgcggccgatgaagtcggtcaggaattcgtgcaggccgctcttgaagatccgctcgaccgacgtatcggacagcatctgcaggatcttcgtggccgtgtcgtgacacgggtgtgtcacgccgtaatcctttgcgagcaggttcaggctcgacacgacgcgcccgtagcaatagcgcagcgaacgcggcatgcggccgttcaggatcaggtagtcggcgatgttcatcggcttgtactgcacgtcgtacacccagcggtacgaacgatgcgcggcgacgcagcgcaggatcgtctcccactggtagttgtcgaggatcgtgccgacgtgcgacaccgacggcagcagcaggtggtatttcacgtcgatgatccgcgcggtgttgtcggcgcgctcgacgaacgcgccgatctgcgcgaaatcgaagatctcgttgcgcagcatcgtgctgtagaagctgccgaggatcagcgcggtttcgcgcttcacctggtcgagcacggccggcagctcgctttccggcaccggctgcgcgagcgcgcggcgcagcgcgagccaagcgccgttcacgctctcccacgcctcgcgcgtgagcgccgtgcgcaccatccgcgcattcgagcgcgcggcctcgatgcacgacagcacgctcgacgggttgtcgcggtcgcgcagcaggtagtcggtcacggtatcggccgcatacgcgtcgtatttctgccggtaaccttcatccgtgcccgagctgacgagcaccgacgaccattcggccggcgcgtcggacgtgcgcgtgagcgccatccgcagcccggcatcgacgatgcgcgcgatattctccgcgcgctcgatatagcggtacatccagtagagaccgcttgcagtacgtcccagaagcatctcgtgtccactccgtcttcgttcggttcgcgcgccggctccggcgcgcggtagcatccggctcagtcggccagcacccaggtgtccttggtgccgccgccctggctcgagttgacgacgagcgatccctccttcagcgcgacccgcgtgagcccgcccggggtgatgcggatccggtccgacaccagcacgaacggccgcaggtcgacgtggcgcggcgcaaggccggcgtcggtcaggatcggcgtcgtggacagcgcgagcgtcggttgcgcgatgtagttcgcggggcgcgcgcgcagcttcgcggcgaacgcctcgatctccgctttcgacgcggccggcccgaccagcatcccgtagccgcccgagccgtgcacttccttcacgaccagttcgtcgagatggtcgagcacgtacttcaggctgtcggcctcgccgcagcgccaggtcggcacgttctccagcagcgccttgcggcccgtgtagaactcgacgatctccggcatgtacgagtagatcgccttgtcgtcggcgatgcccgtgccgggcgcgttcgcgatcgtgatgttgcccgcgcggtagacgtccatgatccccgcgacgccgagcaccgaatcggggcggaacgtgagcggatcgaggaacgcgtcgtcgacgcggcggtacagcacgtcgatcggctggaaaccttcggtcgtgcgcatcgcgacgcggccgtcgatcacctgcaggtcgctgccttcgacgagatgcacgcccatctggtcggccaggaacgaatgttcgtagtaagcggagttgtggatacccggcgtgagcaccgcgacggtcgggttgtcggcgttgccgcccggcgggcatacggccgcgagcgactggcgcagcatctgcggataggtttcgaccgggcgcaccttgacctgctggaacagctccgggaagagctgcatcatcgtctcgcggttttccagcatgtacgacacgccggacggcgtgcgcgcgttgtcctccagcacgtagaactcgttctcgccggtgcgcacgatgtcgacgccgatgatgtgcgtgtaaacgttgccgggcggccggaagtcgatcatctccgggatgaacgcttcgttgtgcgcgatcaggtgcttcggcacgatgccggcgcgcacgatttcctgacgatggtagatgtcgtcgaggaacgcgttgagcgccatcacgcgctgctcgatgccgagcgacagccggctccattccgtgcccgagatgatgcgcgggacgatgtcgaacggaatcagccgctcggcggcctccgcgtcgccgtagacggcgaacgtgatgcccgtcttgcggaacacgccttccgcgtcgtgggctttctgggcgaggctcgcgggattctgcgtgtcgagccactgcttcaggcgcgcgtaaggcgcccttaccatgtcgccggattgcagcatttcatcgaatggcttcatcgatcttttctccatcgatcgttttccccggcattgcgcatgccggaccggcgtaacgactgcgttgcaaggaacgtgccttgcgggctccctcgataatcccccttttgcgccgcgccaggcacgcccgggcgatattgcgcaccacagtggtgcagcccccgacgcgacgtgcgacgacggtgcgtcgcaggcgcgcacggccgatgctgcgccgcgtcttccgaacatagttccccgcgtgtcacgaatgtgcaatctgcactgcacaaaaaaacggcgcgaccgggcaccgggccgccacaatggaggcgggccggcacgcacacggcgcaaccggccctggggaagtaccgtctgcggcgcgcgggcagttcgatgctgtgaactgtccggttagccggatccggcacctcaacgctatgcagccgtaatcccgccgacaacgcccatgcatatttcgactgacaccgatcgaaaaacatcgggccgacccatgcgaggcgcggtacgctagaaaattggtgcagcacggggtgccgcccttcaggcgcccgactataaaaagcgaagatcgaaatggaagcaaagtggctggaagatttcctgagccttgcggataccaagagtttttcccgggccgcacgtcaccggcacctcacgcagtcggcattcagcagacgaattgccgcactcgaaacctggatggacgcgaagctggtcgaccggagcatcaacccgatcacgctgacgccggccggccagatgttccgcgggctcgccgctgacatcctgcgcagcatgtatgcggcgcgcaatctcgtgaacggctacgaccagttcgcggccagcgatcaggtcgtgcgtttcgcggtcgcccatacgctcgtcttcacgctgtttcccgaatggctcaagcagctcaacggcgaagtcggccacgtgaccgcgcgcgtgaacgcggtgaacgtgccggaaggcgtgcagcagctcgtcgaaggtgaatgcgacctgctgctcggctatcaccatccgcagttgccgatcgtgctcgacccgaaccacttcccgttcgtcagcctcggcgtcgaacggatcctgcccgtatcgacgcccgatgcgcgcggcaagcccgtgttccagctgccgggcacacccgacgcaccgctgccgctgctcgcgtattcgtcgggtgcgttcctcggcaacatcgtcgagatgctgctgctgaacgcaaccgagccgtacgtggtgcaccggtgcttcgagacgcacatgtccgaggcgttgaagggcatggtcgtggccgggcacgggatcggctggctgccggaaagctgcgtcgcgaaggaactcgcggaaggcacgctcgtatgcgcgggttccggcgactggatcaccgaactcgaaatccgcctgtatcggtcggcccgcaagcgcgggctcgcggccgagcaactgtggacgtacatcatgaaccggccgcgcgcagcggtcgaaggtgccgtcggcgcagacgaacaggcatccgcgccggcgacgcgcatcgcgcggcgcagcgcgggcgccggccgctgatcttcgcgattgtgtttgcgttcgcgttcgcgtcgtgtccggcgacgacgcgaacgcaaccgcgaatttcagccatgcggtgtgcgcatgcatccgcgtcgcttcccggcgaacgcgacccgcttttccgacagcaaaccgcgatcccgacgtcgcctgaaaaataacgcgccagaccggcaatcgttatcagtggaatcgcaaacgtttgcaattcacggcttgatttttacatccgacacgatacccggatatattccgtcttattatcaggacagaaataacctgttacagaacaaattaaaagtttcgattcacccgtaacaatctaaaataccagcaacgtcacactgccctgttatttcgctcgacctgtacccgaatcgacctcgattcgccgcaaacacagtcgcaaatattccttttatcagtcgttatttttcggcacgaatgccgatacgacagacgtgattcaatgcgtgcgggatcatcgctaccgaatagcaatattcatattcggcaatatcgactttcttcagtattaagagagtcatgcaaatccgcccttatcctatgtaaataggatatttcaccgccgtcccattcgggccacacgcgattgttggttcgtaatccatcgtgtatcaatagcgtgtcgcaaaagaacgctggcaaatttgactcggaataaatactcgtcattgattccggaacggaggttgcaatgccttcctcgattcgacagcacgctcgccccttcctgagcgccgccctctccgcgctctgcatgaatgcaacggcccagacgcctgcgtcgggtcccggcgacggacgctacgtgatctcgtatatctgcggcgacgcgcggatcgacggcacggcgccgctgcctcccgacggccggccatacaacctgggcgtgtcgtttgcttcggccagcaccgggcagccgcttgcgaatgtgcaggtgcgcctgcggcgccatgggcgcgtgctcgtcgaattcaacgcgtcggggtcgcgctgcctgttcagcgtgcccgacgcaagttaccgggtggaagggacgtaccagggcgccacccagttcgcgatcgtggaaacggggcactctccacgcagttgcgatggtaagtcccgcctgaccccgccccgatcacgccattcaccgccgcgcatcgaatcaaggagcattgcatgcctcctgccgaacgaccggaccgctcgcccgcccccagccgaaaccctcctggggcccgggaaaaacgcagcactcagcttcgtcgcgttcgccacgatcttcggcatcttcgcgtatgccgagcgagacacgacagtcggccacccgagcgtggcgcacgacatctccagcgcaatcggaaccgcggtcgggaagtatcgcaacgcgatcgtgaccctggcctcccgcgcgagcgcatcgtccggcacatccgtcgcgcccgtgccggcgtcgacacgcgcgcaggccgtaccacccgcgccgccatggcaggcagcgtcggcgtcggctgcacccgaggtatcgaccgtgccgcccgtcacgctcgcggtcgcaccggaaaccgcgccgcaccccgcttcccgcgccgtcgcgacgcaccggcggccgtcgcacgcgccacccgtgacactcgcggccggtacgcagccggcaaccgcctccggtcgcgccgccacgcggcacggcgccacgcatcggccgccgcatgcggacacgctggcaggcacggacaagcggatgaacttcgcgcccaaaccccgggcgtacggcaccgaccccgcgcgcatgcagacggcgagcgtcacgcacgcggaactggaaagcgcgcgtgcgctggcgaaggcgcgctcgtgcgcggtgatcgacgaatggaactgtgtcgagcaaaacgcgagccgggcgctcgcgatcgacccgacgaacagcgaatcgcgtgccttgctcggccaggcgatccgtaaccggctgtgagccggcgccgcattgccgggcactcgcagcccggccgcgcgacacgcgacgacgtgcctcgtcacgcgtgtcaccgatgtgatcgtttcgaaaggaggacacctcgtggccaacaatcatcaacaatcctgcacggccgtcgctccgtccaaccggcggatcctcctgcatgcgccactggtattgctgctcgtcgcgtccggctcctgcttctccgccgaaggcgatacggagtcgggccgcatcagtgaaatcgccgggtccgccggcacaccggaccggaggccgcccgacgtgtcggcacagggttcgcccgcgccggacgtgcaaccgccgaatgcgcggacgctgatcgcgcaggcatcgagtgcgcagatgtccgacacgtcgactcctgccacttctcagcccggttcgcagcccggtcagcccccgatccgcaaacgccgggggcgccgacgtcgagcccgtcgacaccgggcatgccggcgccgaacgcgcaggcccccggcgcgcagccgccagcttcccaggtacccgaagcccaggcgccgaacgcgcagatgcccgacctccgcaccgccgatccggccacagtccgcaacgacgtgttcggtcttgcgtcgagcggcggcgcggtcaaggcgctggaggaagcgaaagcgcgccccgacgtgttctccgcggtcgatctcgcgcggctcgaggaactgtcgatccgccagcaggtgcgcggcggacgcgacaagtcgcgctcgatgacgagccccgaccgcttcgacgggatcgacaacgcgctcgccgccgcgaacgacctcgacaagcggatgccgtccacgcccgagtattcgccggtcaggacggcgctcgccggcgaccggacggtagcgctggcggcacgcggcgagatgaagcaggccgtcgcgacgttcgagacgatcccgccggacgcggagatctcgatcgacgcactggcggccgtcggcgacgcgtacctgtacctgagcgaaccgggcaaggccaacgcggtataccagcgcgcgctgaagcaggcgaccgcgccgcaggccgacatcgcgacgcgcggcttccagtacggcgcacgcacgcgcccgatcgaattgcgagaggggctgttctggtcgtacgtcgaccagggacgcgcggccgatgcgaacctggcgctcgaggacatgggcaaatcgctgccgccggccaaggacgtgcgcacctgggggccggaaaacgacgactacctgcgctactaccggctgcgcgcgcaatacctgatctacacgggccgggtggacgaaggaatcgcctcgctggaaaaactcgagaaggaagtgccgttcaacgcggaagtccgcgccgcgcatgccgacgcggtctcgggccagtcgcacccgcgccaggcgatcgcgatgtatcgcgcgtcgctgaccgaccacccggacagcgtcgagatgctcgcggggctcggccgcgcatcgctgacggcagacgattacgcgagcgcgaggaacgtcgaccagaccctgggcaacacgttcccggacagcggcgccgtgcgcgggttcaagcgcgactacaaggcgtatcgcagccccgtgttcacgaccgacctgagcttcgagcacggcaacagcgcgctggccgacaacagcttcacgtcggacagctatgtgtattcgcaaccgttcggcgacaactggcgggtcttctcgcatacgttcttcggccatgcccaaaccgacggcggcaacgtcagccgcacgcgcacgggcgtcggcggcgactaccggcacggcccgctcaccgtgctgggcgaagtcacgcgctcgttcggcgcggacggccgaaccggcggccgcgggtcgatcgcgtacgcgctgaacgactactggacggtgggcgccgggctcgacaccaacgacaactcgctgccgtggaaggcgtatgccgcgcacatctggggccgctccgcgaacgtctcggtcgtgtatcgccagagcgaccgccgcgaagtcaagctgagctacggcgtgagccgctacagcgattcgaacctgcaccaggagatttccgcgaccgccacgcagcgcgtgtacacgtccgccacccagctcgtcaacgtatcgctggacctcggcaccgacagcaacacgcggcaggacgccccctacttcaacccgggccgcgactatgcggccgcggcgaccgtcatgcaccagctgacgctgtggaagaagggcgacatgtcactgcagcagcgcctgtcggcgtcaggcggtgtttacaacgagcgcggcttcggcacgagcccgctgtggaccgcgcgcctcgagcacgcgtggacattcaagcacgacatcacgctgacctacggcgtcgaaatcagcagtcatgcgtacgacggccagcgcgagcgctcgaaaccggcttcctgtcggtcaacctgccgttctagcaaggagatcggacaatgcaatccagacggaccttcatgtgcggatgcctcggtacgtttgcggcctgttcgttgttccccggcgtgtcgaacgccaggatgatcgacctgctgccgccgtccgatccggtcgacggcaagacgttccgcgtgatctgcatgcatgacgtgcgcgacaacctgctcgcgacgttctcgtcgtcgacgatggtcgatccgtacgcggtcgataccggcacgctgacggccatcttctcgtggctgcagaccaacaactaccacaccgtgacggtcaggcagatcgaagcgtcacgacacggcggcaagccgctgccgccgcgcgcggtgctgctcacgttcgacgacggctacagcagccactacacgaaagtcctgccgctgctcgagcgcttcaagtatccggctgtgatgggcatcgtcaccgcctggatcgacgcgccgctggatacgccgatcaagatcagcgacaaggtccagatgccgcgcgactacttcatgacgtgggaccaggtgaagaaggtcggccagtcggaattcgtcgagctcgggtgccacacgcacaaccttcatcacggcgcggtcgcgaatccgcaaggcaacgaactgccggcgaccacgtcgcacctctacctgcaggaccagaaacgctatgaaaccgacgccgaattcgaagcgcgcgtgcacgacgacctgcagacatgcgtgcggcagatccgcgaacgcaccggcatcgtcgcacgctcgatggtctggccatacggcgcggaaaaccagcccgtgcgcaagatctcgacgtcgctcggcatggacatccagttcagcctcgatgccggcccgaatacgccggacgtgccgctcgaccggttgcggcggatcctgatgatgtacgacgtcgacatcggcgggttcgagcggtcgatgcgcgagccggcctccaaccgcggcgacgtcgacattcccgagcgcgtcgtgcaggtcgatctcgaccaggtctacgatcccgacccggcgcgccaggaagcgaatctcggcaagctgatcgagcgcatctaccggatgcagccgaaatcggtatacctgcaggcgtacgccgacccgaagggcacgggtgtcgcggaatcgctgtatttcccgaaccggcacctgccgatgcgcggcgacctgttctcgcgcgccgcctggcagctcagcacgcgctcgaacgtgcaggtgtatgcgtggatgccggtgctcgcgttccggccgcgggcggacaagcatcgcggcctggaagccgtcagcgcatacggcggcgcgccggcgcgcgagaacggctcgcgcgtgtaccgcctgagcccgttcgaccccgaagcgcggctgttcatcgagcagatctacgaggatctcggcaagtacgcgtcgttcagcggcatcctgttcagcgacgacgccgtgctcgacgattacgaagacgccggccggcacgcgctgagcacgtacgcgcaatggggcctgccggccgacatcggcaagatccgcgcgacacccgacctgatgaagcgctggacgcggcagaaaagccgctacctgatcgacctgacgcgccagctggaacagatcgtgctcgcgaaccagaacgccggcgacgtgctgacggcgcgcaacatcttcgcgctgccggtgctgaagccggaatcggaagcgtggttcgcgcaaaactacgacgatttcctcgccacctacgacttcgtcgcgctgatggcgatgccgtacatggaacaggcgcaggaccccgagcgctggatggaccagctcgtcgacgccgtccgcgcgaaacagctcggcaccaggcgcaccgtgttcgaactgcagtcgtacgactggcacgcgcgcaaggacatcggcggcaccgcgctgctcgcgcagatgcggcgcctgcgcagcaagggcgcggtgaacttcggctactacccggacaacttcctgaacaaccagccggatctcgacacgatgcgcgacgtgatgtcgctgaagtcgcgcctcgatccgacttcgatcaacgcgctgatgcagatgcagaaaacacaggggacgaagacgccatgaccagccacagcatcatccagcgcctgcaggatttcgtcttctactacccgttcttcatgtcgtacctgtggatgatcggcggcgtcgtccattacttcctcctcgaggaagggcgcgtgctgtcgacgcgcacgatcgcggcgagcgggatcccgaagatctcgatcgtcgtgccgtgcttcaacgaggcggcgaacgcgcagagcgtgatccggcacctgaacgcgatggactacccgaactacgacatcatcgcggtcaacgacggcagccaggatcgcaccggcgagatcctcaacgagctggccgtcgagatcccgcggctgctcgtgatccatcacgcgcgcaacgaaggcaaggcggtcgggctcacgaccgcggccgcgatgtcgaacgcggaatacctgctgtgcatcgacggcgattcgctgctcgcgcacgatgcgatcggctggatgctcgagcacttcctgaccgacccgggcgtcggcgccgtgaccggcaacccgcgcatccgcacgcgcacctcgctgctcggccgcatgcaggtcggtgaattctcgtcgatcgtcgggctgatcaagcgcacgcagcaggtgtacggccgcatcttcacggtgtcgggcgtcgtcacgatgttccgcaagaccgcgctcgccgacgtcggctactggagcgcggacatgctgaccgaggacatcgacatcagctggaagctgcaatgccgcgactggcgcgtcgtatacgagccgcacgcgctcagctggatcctgatgcccgagacgctgatggggctctaccggcagcggctgcgctggtcgaaaggcggcatccaggtgctgctgaaatatgcgggcacgctcgcgcggccgacgcagatgatgatgtggccgctgttcgccgagtacctgatcgggatcgcgtgggcctattcgatgtcgttcatcctgctgctcgcgctggtggacgtcgtctatccgctgccgctgagctggcacgtatcggtcgtgccgcactggcacgggatgttgctggttgcgacctgcatcctgcaactgatcatcggcagcatgatcgatcgtcagtatgacgaaaaactcctgatgtacttcctggacaccatctggtaccccgttgctttctggctgatcagcatgatcaccaccgtcgtcgccctgccggccgtcgtgctgcggggccgcggcaagcgggccgtgtgggtcagccccgaccgaggcattcaacatgaagaacgcgccgattattgacctctcctgcgcacgccgcgcgaaatgatcaccgaacgcggccgcgtcgccgggctcgcgcaggtcgtctggttccgtctcgtgcggcccgcgctggtgggcgccgtatgggcgtcgatctgcatctatacgtatcgctacctgctgccgttcaacccggccgagatgccgatcgaacagatggtgttctacgcgaccagcatcgcgatcatcgcgggcgccatcgtcatgtggctgatcgccgggcgcgtcgtgcatccgctggccttccggctgcgcgtgtcgaagatgctgcggcgttcggccagcgcaaaggtgcgctcggtgccgccgaccgtactggccagcgcccgtcggcgcggcgcgcgccgcacgacgcgcattctcgtcgcgtcgcacgacgcgaacggctcgatttcaggcatcgaatgggtcgcccacgcggggccgccgccccgcgagtaggtcagcggagccgcgccgccgcgcacggggccgcatcggtgccgcgcggcgccactcctgaagccgcactgccgcgctgtgccggcaggccggcaacctttgcagtttttgcagacgaggtgaatcatgtgcggaatcgtcggagcaagcggcctgaacaatcaggtgccgcaactggtcaatgcgctgagccggctcgagtatcgcggctacgattcgtgcggcatcgccgtgcaggacgacggccgcctgcgcagcgagcgcacgctgcggcgcgtgaccgacctgcaggcccgcgtgctgacgctgggcctcgaggcgcagacctgcatcgcgcatacgcgctgggcgacacacggcgcaccgtcggaaatgaacgcgcatccgatcatgtccggcgacacgatcgcggtcgtgcacaacggcatcatcgagaaccacgacgcgctgcgcgttgagctgcgcgagcgcggctacacgtttcgcggccagaccgacaccgaggtgatcgcgcacctgatccacagcctctatcgcgacgacctgttcgacgcggtcgtgcgcgcggtgaagcggctgcacggcgcgtacgcgatcgccgtgctgagcgcgcgcgagccgcagcgcctcgtcgccgcacgcgcgggctcgccgctcgtgatcggtatcggtgccgaacagaactacctcgcgtcggattgcgcggcgctcggcgacctgaccgaccgcttcgtttacctggaggacggcgacgtcgcgctgatcacgccggagcgcatcgccgtggtcgactcgggcgggcacgacgcccagcgcccgctgtgccaggtgaaggcgcgcgaaggcgacgccgcgctcggcccgtatcagcacttcatgcagaaggagatcttcgagcagccgaaggcgatcgacaacacgctcgacggcatcgacacgatctcgccggcgctgttcgacgcgaccgacggcgcgcgcgcgcgactgtcgagagtcaggagcgtgctgctgctcggctgcggcaccagctactacgcgggcctgaccgcgaaatactggctcgagtcgatcgcgggcgtgcccgcccaggtcgagatcgccagcgaattccgctaccgcgacacggtggccgatccacgcacgctcgtcgtcggcatttcgcaatcgggcgaaaccgccgacacgatcggcgcgatcgaacgggcacgcgacatgggccaggaactgtcgatggcgatctgcaacgtggcgaccagcacgatcgcgcgcaacgcgccgctgcggttcctgacacgggccggcatcgagctcggcgtcgcgtcgaccaaggcgttcacgacgcagctcgtcgcgctgttcgtgctgacgctgacgctcgcgcagctgcggggccggctcgacgcggcgcaggtcgcgctgcacctgaaacagttgcgtgcgctgcccgagcgcatcggccacgcgctcgcgctcgaaacgcagatcatgggctgggccgcgaagttcgcgcgtaccgaaaacgcgctgttcctcgggcgcggcattcattttccgatcgcgctggaaggcgcactgaagctcaaggaggtgtcgtacatccacgccgaaggctatgcggccggcgaactcaagcacggcccgctcgcgctcgtcacgagcgcgatgccggtcgtcacgatcgcgccggacgaccgcctgttccagaagctgaagtccaacatggccgaggtgcgcgcgcggcgggcggctctacgtgctggcgggcagcgcactcgacatcgacgcagaccgcgacacgcacctgatccgcgtgcgcgaatcgagcgacctgctgtcgccgatcgtcaacgtgatcccgctgcaactgctcgcgtatcacgtcggctgcgcgcgcggcgccgacgtcgacaagccgcgcaacctcgcgaaatcggtgaccgtcgaatgaggtggcgagcgcgtccggcacaggcggtcgcgcggtgcgtcgcggccgcgctgtgcggcgcatgcggcatcgtcacggcgccgccggccttcgccgccacgccggtcgtgcatacggtcgccgtgccggccaccccgtcccccacccggccgccgatccgcgcagcttcatgcacggcatcggcgtggccgacgccggcagcggcaagcgctgggtgttcttcagcagctcgggcatcgtgccgcgcggcgcgatgcgcaacggcaactggccgcatgacgtgtacgtcggcgaatggctgcccggcgcggcgcacctgctgcacgtccatacgttcatcagccgccccgaggcgcaggaacccgtgtcgatcgcgcagaacgcgcgcggcgacatcttcgtgacgttcgaggacggctggaacgcgccgcaggaagtcagccagcgctacggcgtgtaccgccgcgacctgaagccggtcaagccctacccgaacgacgtcgaatcgggcggccactcggggcacgtcgccacggctgccgaccgcttcgtcgtgttctattccgccgactggatcgacggcggcggcgtcgacaacctcggcaccggcaacggcgtttacgtgaagacctacgacgcggccgggcgcgtgctgaaccacgtcgcggtcgcgccgcaccgccgcgagtggtggcccgtggtcgcgggctcgccgcatgccgcgctgctcgtgtggcagaagttcatcgaaggcagcacgagcgcgacgctcgaatacgcgatgttcgacccggtcaccgcgaagctggacaagctggggacgctgaacgacacgatccagtactacgtttacgcgtcggcgtatgtgccggagatcgaccgcttcatcgtcgtcacgacgacggcggacgatcgcggcatcgcgatgctgatcgcgccggacggccgccgcacggcgacgctcgactgcctgccggcgtcggtgcgcgaatccggcatcggggtgtccggcacgcatgcgtacgtgccgatccgcgacgggcggctgctgacgctggcgctcgggccggcggagatcgcggtcggcggcgtgcagcgttcgccgattccgtggggcatgacgggcatcgccggtttcccggcgcgcggcagcgcgatgcatttcgtgtcgctgacgccatcgggcacgcgcgaagccgatttcgaaccggcgcatgacacgccgatgccgaaacgcgcagtgccttgctcgagtcattgaagcgacatcgcgccggtgacgcgcggctcatgccggatgggtgcggtcagtccgcgttttcgcgctccagtccaaaccgcgccatgcaatgccacacccatttggccgtctgatagtcgagtgtgccgtcgcgcgcgcggccgagcacggccggcgtcacgatgcggtcgacggcgatgcgttcgatcgcgccggcggccacgatcgtcggatatgggcaagcgcccgctctgccggggagtccatgcgtgctgtccggtctcgtcgaatgccgccgggccgcgcggcgccgacggtatcctcgcgcccgcggcccggcgtcggttgcggctggccgcacccggtgcgtgacgaagcacgatacaccgtcgcgcggaaccggtcacccgtcccgcgccgcagtcgccagcgccgcgcgtaccggatagactgtcgcccgattccttccatcggccgcggcgcccgcctcctgccgccgccggaacgcccctcccggagaacgaatgctgaagcgccagtggttttcgctcgtgctgctgacggtttgcctgctaggacaacgcgcgtcggcccagtccacgctcgaactcgacaccgacggcacggcccgcaccctcacccggcagacgctgctcgcacgccccgacgcgacggacatccgtgtgccgcgcgacatcgcgtacggccggccgatgacgttccgcgcggtgccgttcgccgcgctgctcggcgacacgccgctgcccgccgacggcgtgctcgaaacgcgcgccgccgacggcttcgccgcgcaactgccgctggatctcgtgcgccgccgtgcgccggccggcgccgttccgtggctcgcgatcgaggacccggcccatccatggccgaagctgcccggcaagcaggtcagcgcggggccgttctatctggcgtggctcgggcccgacgccgcgtcggtgcgcggcgagcagtggccgtaccagatcgtgcgcgtcacgatcgaatcgtcgccgctcgcgcgctggccgtcgcttgccgtggatgccgcgttgcccgccgacgatccggcccgcgcggggcagcacctgttcgtcacgcaatgcctcgcgtgccaccggctcgacggcgcgggcagcagccatgccggccccgacctgaacacgccgatgaacccggtcgactacttccagccggccgcgctgcgccgctacatccgcaacccggcatcggtgcgcgactggccgggccgcgtcatgccggcgtttccgcccgaccagttgagcgaccgggaactcgaacagatcgtcgcgtatctcgcgtatatggcgcggcgcaaggccgctcgataacgcgcggcccgactgcacgaggaacgttgatgacttcaggcgacacgctgttcaccatcgcatcgatcgacgccgcgcagacgcacccgctccgggcagcgatcctgctgaacggcgacctgaacgcatgcgaactggctggcgaccatgcaccgacgacgctgcatgtcggcgtgcgcgacgaccggtcgaacatcgtggcggtcgcctcgctctgcgaggagccgcgcgatgacgatccggcacggcccgcgtggcggcttcgcggaatggccgttcatcctgccgtgcgtggcctgggcttcgggcgcgtgctggtgcaggtttgcgtgcggcatgcgcaagcgaacggggccgcgctcgtgtggtgtacggcacgtgaagtggcgtaccggttctatgaaaagctcgggtttgcggccgatggtgccttggtcacgatgccggggcgcaccgatactgcgttttacgtgatgcgccgatacatcgatcggcattcgccggcggcctgacgcgaatttcgtgttcgcggcgccaggccgaaaccggcgcggcccggcgcacaccctgccgccgggccgctgccgtcacgctcgggctcaggcctcttgcgcgctccgcaacaccgcacgcaacagcacatccgccccgccgccgcccactcgggcgtaatcgcttcggcctcgttgtggctcaacccgtcgacgcacggcacgaagatcatcccggtcggcgcaacgcgcgcgacataacacgcgtcatgacccgcgccggacacgatgtccatgtgcgacagcccgagcgcccgtgccgcgtcacgcacggcgtcgatgcagcgcggcgcgaacgggatcggcgcatacgtgaaaatctgctcgatctgcgcaccgaggcccgtttcatcggccactcgcgcaagttcggcacgcagcgccgcgtccagttcgtcgagcaccgcatcgtccggatgacgaaactcgaccgtgaagaagcagccgcccggcaccgtgttgcgcgagttcggccgcgcctcgatcatcccgaccgtcgcgcgtgcgtccggcgcgtaacggcggccgagcacctcgataaacgagatcatccgcgcggcgccgaccagcgcatcgcggcggacctccatcggcgtcgtgcccgcgtgcgcgtcgacgccggtgagcgtcacttcgtaccagcgctgcccctgcccgcccgtcacgacgccgatcgtcttgccggcccgttcgagaatcgggccctgctcgatatgcagttcatacgccgcgtgcaccggatagccgccgacgggctcggtgcccgcgtagccgatccgcgccagttcctcgccgatcgtcctgcccgcgccgtcggtgcgcgacagcccgtattcgagcgtatagacacgagaacacgccggccgacaccatcgccggcgcaaaacgcgagccttcctcgttggtccagatcacgacgtcgatcgggcgctcggtctcgacgcccgcgtcgttcagcgcgcgcacgacctcgagcccgccgagcacgccgtagatgccgtcgtagcggccgcccgtcggctgcgaatcggcgtgcgagcccgtcatgaccggcgcggcgtcgggattgcgccccgggcggcgtgcgaacacgttgcccatccggtccacgcgcaccgtgcagccggcgtcctgcgcccattgcacgaacaggtcgcgcgactcgcgatcgaggtcggtcagcgcaagacggcagacgccgcccttcggcgtcgcgccgatctgcgccatccgctcgagcgacgcccacaggcggtcgccgtcgacgcgcggcgcgctcacgatatccacgctgccatgatcgtcacgcatcgccgttctccggcgcggattgcagtgcgtaacggaaatcgcagcgcttgccgccctgcatgatcgtgctcgtgcgcgtgagcgcgatgtccggcgcataaccctggatgaaatggctgtcgcgcgcgcagctcagcagatgcccgatctcgccgagccccatcgcgtgatacatctccgcgtagctacagcgatgcacgtcgtagtcgtagtgcgcgtcgtccgcgcgccgcacttcgacgtcgagcgcatcgtccttctcccacagcacctgcagcgcgatgaacgacttcacgctcgtgccgcccggctcctgtgcggcgaacgtgcggccggccgcgacggccgcgccgcgcacggcttccgcgatcacggcctgtgcgcgctcggcgccgaactcgcgcttcatgatctcgtagatcggcttgatgatttccgcttcgatgcggcgccgcgcgaggatcccgaggcgcgtgtcctcggtgcggcggcggatgtctgggtcgcttcggtcatggggatcgtccgggtcgttttatcgatgtgtcgcgctgtgttgcgccgtcttgtttacttggtcgcggtgcgcgagccgccgagcacgtcgacgacggtccacttgccgccgcgcgcctggtagatcgtgaaggccgggtccttcaggttgccttcgccgtcgaacgcgatccgccccgtcacgccgggccggtcgatcgcacgcaccgccgcgaccagcttcgccggctgcgtcgtgccggccttctgcgcggccgcgatcagcgtggccgccgcgtcgtacgcgaacggcgcatgcagttcgatcggcgcacggaagcgcgcctggtattgcgtgtcgaatgccttgccgcccggcatccggtcgagcggcaggcccggttcgagcgccgtcacgccgtcgccgtccttgcccgcgagcgacaggaaggtctggctcacgaagccgcccgcgccgagcagcggcgcgttcacgccgagctggcgcatccggcgcgcgatcggcgccgcttgtgcatcgaggccgccgaagaacacgagatccgcgcgcttgcccttgatcgcggtcagcacgccgctgaaatcggtcgtcttgtcgttcacgtactggcgatcgacgaccgctccgccgttcgcctgcacgcccttgatgaactggtcggcgagccccgcgccgaacgacgtgcgatcgtcgatcaccgcgatacgcttcgccttcagcgtcttcactgcatacgcacccgtgaagttgccgcccgcatcgtcgtgacccatgatgcggaaggccgtcgcatagccctgctgcgtgtattgatggccggtggacgccggcgcgatctgcggatgcccgcatcgcggtagacgcgcgatgccggcacgctgcagcccgtgttccagtggccgacgacgccgatcacgtgctggtcgacgagctgctgcgcgaccgcgacggccgtgcgcggatccgattgatcgtcggccgcgacgagcttgtagacgaccggcttgccgccgatggtcggatgcttcgcgttcgcatcgtcgatcgcgagttgcgcgccgttctgcaggtccttgccgatccgcgcggacgggccggtgagcggcgcggcgagaccgatcaggaccgtctgcggcgcggattgcgcgaaggcgggaaccgaggcaaccagggcggccgccgagaatgcgaggctggcgtggaggaaagcgattttcatgtgcggggatcggtggatcgaatcaaaacatgaaaaatattaaatattgagcacccaaatcccaaatatccaattgttggatgcttataccgctggcgatacattaacctatatcactgtaaatgcaggatatttttgtgttgtcgcttaccctgatttttcgataaaattcgacacatgaaaaatatcgaacaattgccgcacgatccaccgctgcgcgcggtgcgtgcgttcgaagccttcgcgcgcctcgggtcggtgaccgccgccgcgggcgagctcgacatcacgccgtcggcggtcagccatcagctgcagctgctcgaggcgttcatccagacgccgctgacggtgcgcgagggccggctgctcgcgctcaccgacgaaggccgcgattactaccgctcgatcagcgccgcgttctcggtgctgcgcagcgcgacgcgcttcgtgcgcgaccgctcgtcgctgcggcagatcaccgtcagcctgattccattgctcggcatcggctggttcattccgcggctgcatgcgttcctggccgacaacacggacgtcgacgtcaccgtgttgtatgcgcatcaccgcaactaccgcagcgatgcgtcggacctgtcgatccgcttcggcaccggcgactggcccggctatcgctgcgaacgcctgctgccgggcgcgatggtgccgatgtgcagcccgtcgttcctgaagcgccacgggccgttccgcacgccggccgatctcgcgcgcgccccgctcgtgcacgacgaggatcgcagcacgtgggtcaactggctgcagggcgccggggtgcggcatgtgtcgcacgcggtggggccgatgttcgaggacggccaattgacgctgagcgccgcgcgcgcggatctcggcgcggcattgctgcgcgcgccgctggtcgaacgcgaactggcgaatggcgagctggtgaaactgttcgatcacgcgctcgacgacgggcgcgattactacctgtgcacgcgcgaggacgcggacatgccggacggggcgcggcggctgagtggttgaggaagatggcggggatttgagcggggtacgctgcgccgattcgcttgctatcgtcttgcggccgaaagatctggtatatatgatatgcatatcatatatcggaggctatcatgagccgaattctggtcgatctgtcggacggccaactcgacgagttggccgtcatcgtcgagactcaacatcgtccccgcgccgcaatcatccgcgacgcgatcgatgcctatattgccttgcacaagcaccggcttgccgacgacgtcttcggtctctggaaagatcgcaaggtcgacgggctcacctatcaggaagaactgcgctcggaatggtaaaagccctcttcgataccaacatcctgatcgactatctgggcggcgtggaatccgctcgtgcggaactgggccgctacgactatcgggcgatcagcacgatctcgtggatggaggtcctggccggcacgtccgcacaggacgaggcacccatccgcgcgtggctgtcgtcgttcgatgtcatcgcactggacagcccggttgcgaatcgtgccgtgacaatccgcaaggaacgccgcatacgccttcccgatgcaatcgtctgggcatcggcacaagtgaacggtctactgctcgtgtcgcgcaacacgaaggacttccctgccaccgaacccggcgttcgcgtgccctacaagctctgagtcagcgccaagtcacctccgagtccgagcccgttgtatgcgccggaactcggccctcccgcagcacctgatacgaacgcgcgagacgaccatcctgcgcacgcaatgtgccagctactcgcgccggcacgccacgccaaactgccccgctgtcaacccgcattcatcggctatccgcccaccgcctcacaagccccacccaatcaagggccggaagcagatagaaattcccgatgccccggattgaaacaagcaatttcacaagctcagggtgaacccggatactggcaacactccactcaccactgaagcaaaggaactcaccagatgccgatcatcaacacccaaatcaagccgttcaaggcaaccgcttaccacaacggcgacttcgtgcccgtctcggaagagaacttcaagggcaagtggtccgtcgtcgtgttctacccggccgacttcacgttcgtctgcccgaccgagctgggcgacctcgccgaccgttacgcggaattccagaagctgggtgtcgaaatctacggcgtgtcgaccgacacgcacttcacgcacaaggcatggcacgacacgtcggacacgatcggcaagatcaagtacccgatgatcggcgacccgaccctcacgctgtcgcgcaacttcgacgtgctgatcgaggaagaagggatggcactgcgcggcacgttcgtgatcaacccggaaggcgagatcaagctgtgcgaaatccacgacaacggcatcggccgcgacgcaggcgaactgctgcgcaaggtgcaggctgcgcaatacatcgcggcgcacccgggtgaagtgtgcccggccaagtggacgccgggcgcggaaacgctgaccccgtcgctcgacctgatcggcaagatctgacgatcgctccgcgcgcctcgcccgaggcgcgcgagacacgaagacgggccgccgccgcatgcggcccgcgccctcctccggcacgacgtgcccgaccagaatcatcaatacggaatccgaaacgccatgctcgacgccaatctcaagaaccaactgaaagcgtacctcgaaaaatcacgcgcccgatcgaactcgtcgcttcgctcgacgacggcgcgaaatcgcaggaactgctggcgctgctgaacgagattgcgtcgctgacggatcgcgtgaccgtgaccgaacgccgcgacgacgccgagcgcaagccgtcgttctcgatcggcgagcccggcaagccggccggcatccgcttcgccggcatcccgatgggccacgaattcacgtcgctcgtgctcgcgctgctgcagaccggcggccacccgatcaagctcgacgacgacgtgatcgaacagatccgcgcgctcgacggcgactacgcgttcgaaacgtatttctcgctgtcatgccagaactgcccggaagtcgtgcaggcgctgaacgtgatgtcgctgatcaacccgcgcatccgccacgtcgcgatcgacggcgcgttgttccaggatgaagtcgagtcgcgccagatcatggccgtgccgacgatgttcctgaacggcgcgtcgttcggccaggccgcagcagcgtgaaggaaatcctcgcgaaactcgatacgggcgccagcgcacgtgccgcgaagtcgctcgagaacaagccggtgttcgatacgctgatcgtcggcggcggcccggcaggtgcggcagccgccatctactcggcacgcaagggcattgcgacgggcgtcgtcgccgagcgtttcggcggccaggtgctcgacacgatggcaatcgaaaacttcgtgtcggtgcaggaaaccgaagggccgaagttcgcgaccgcgctcgagcagcacgtgaagcagtacgacgtcgacatcatggacgtgcagcgtgccgatgcgctgattccgggcgacgtgcaccagatccgcctcgcgaacggcgcggtgctgaaggcgaagacgatcgtcctcgcgaccggcgcgcgctggcgcgaaatcaacgtgcccggcgagcgcgaataccgcaaccgcggtgtcgcgtactgcccgcactgcgacggcccgctgttcaagggcaagcgtgtcgcggtggtcggcggcggcaactcgggcgtcgaggccgcgatcgacctcgccggtatcgtgaaggccgtcacgctgatcgaatacggtgcgcaactgcgcgcggacgaagtgctgcagcgcaagctgcgcagcctgccgaacgtcacgatcgtcacgcaggcgcaaacgatcgagctgaccggcgacggcagcaagctgaacggcctcgtctacaaggatctgcgctcgggcgacacgcagcgcatcgatctggaaggcgtgttcgtgcagatcggcctcgtgccgaacaccgaatggctgaaaggtacggtcgaactgtcgaagcacggcgagatcgtcgtcgatgcgcgcggcgcgacgtcggtgccgggcgtgttcgcggccggcgacgtgacgacggtgccgttcaagcagatcgtgatcgcggtgggtgaaggcgcgaaagcatcgctcggcgcgttcgaccacctgatccggcaggacgttgcaccggttgccgccgcgcaaccgcaggccgaggaagcggtcgccgcgtaacgcgcgtcgcacatcggtacaacagtttgtctctcttggccccgcatgctttggtcggcgtgcggggccctttattccaggtgcgatcgcggttacttggtcgtggtcggggcgtcgttcaccggcgccggtgacggcggcttgacactgctcgactgcctgaccagttgctcggtcatcgcagcggcaaccggattcgcgcccgacgacgaaccgccctgccggtacgaaccggcgctcgacgagatcgatgatgtcgacgacatcgacgacgccggcggcggcggcaacgacggatcgagcttcgccgattccctcacgagcgcggccgtctccggcgtttcggatttcgtggcggaaggcgccgcggccgcgtggcgttcgagaccgtcgcgcttgcgcggcgcgcgttgcgtgacctgcgcgggggcaaccgcccggcctggtttcgcagccggcgctgcggccggcggggtcgaatcctgcgcgtcgacggtcacgacattgaccttcggcggcggcgcgctcggctgcgctttctcgctgacgacaggaacggcggggacggatgcgggtgcggcactgacacgcgcggctgcgggtgcaggtgcaggcgttgccggggcgggtggctgcgggaaacggctgcccgcttcgatgcggtatcggcccgggccgccggggccggcggcgcgatggcgccctgcaccgcgtgatcgttgttcgcgggtgccacggccgccggtgcggccgaatcgccgatgccggcgtcttcgatcgcacggtggtccgcgcgcaggagcatcacgtaggcagtgccggccgcggctaccaggagcccaccggcgatcatcaaggtcttgcgggtactcgtcatgcttgctcaccgatcatgtcgacgtgaacaagccatcatacgcggcgatcggccgccgatcccgcatgaatacatttggttgcattgtgccggcagcaggtcgtcacgatgttcgtcagacgtatcgccgccccgctccggcacgaccggaacgccgcccttactccggaaacggcaattcggtctgcccgtccgcgcgcatgctgaacgtgttcagcgtcatcgcgacgagcgcgtagtagccgagcaatgcaacgagattcacgacggtttcgtggccgaagcgtgcttgcgcccgcgcgaatgtcgcgtcgctcacgcgccgcgtgtcgtacaactcgctcgcgaacgcgtggatcagcgcatcgtcgtccgattcgaatgcgggcgcgacgccgagccgaacggcgtcggccgtcgcggccggtaaccccgcttcgagcgcgatcggatggtggatgtgccactcggcctgcgagcgccagcgcgcggccgtcacgagaatcgcgagttccgacaaccgcagcggcaggcccgtgcgataacggcagaacgcgccgagcttctgcgcgtgctgggccagctcggggctcgcgatccagccgagaaacggcccgttcaggttgccgcgcgggccgctgaggatgtcggccagcacggccttctgtgcgtcggtggccgacgcgggatcgaacggcggcagtctgtctgtcatggtcatgtcccgatgaggtgcggatgcgctcacgcgccggccgacgcgagcgccgcgtcgatcgcgcccgacagccgctcgacgatcgcgtcgatctgctgcgcggtgcaaatgaaaggcggcgcaacgaggatgtgatcgccgtgaacgccgtcgatcgtcccgcccatcggatacaccatcaacccgcgctgcatcgcttcgcgcttgaccgccgcgtgcagcttcagcgcgggatcgaacgtcgccttcgtgtcgcgatcgcgcacgagctcgacgccgacgaacagcccgcggccgcgcgtcacccacatgcggatgcgcgccgtaatgctcgcgcagcgacgcgcgcaactgctcgccgcgcgccttcacgttgtcgagcagcttctcttcggcaatcacgcgctgcacttcgagcgcggccgcgcacgcggtcgcatggccgaggtacgtgtggccgtgctggaagaaacccgagccgtcgacgatcgtccggtagatgcggtcgctcaccagcgtcgcgccgatcggctggtagcccgcgccgagccctttcgcgatcgtcagcagatcgggcgcgacgccgtcttcgtcgcacgcgtacaggtagcccgtgcggcccatccccgacatgatctcgtcgaggatcagcagcacgccgtacttgtcgcacaccgcgcgaatcttcttcaggtacgtgcgcaccggcggcaccgcgccggccgttgcgcccaccaccgtctccgcgacgaacgccgcgacattgtccgcgccgagctcgacgatcttctgctcgagctcgtccgcgaggcgctgcgcatacgcttcgtcggtttcgcccgccagctggtcgcgataggcaaaacacgggctcacgtggtgcgcctcgatcagcagcggcaggaacggctcgcgccgccacgcatttccgccgatcgcgagcgcgccgagcgtgttgccgtgatagctctggcgtcgcgcgatgaaatggcggcgctgcggctcgcccttctcgacgaaatactggcgcgcgagcttcagcgcggcctcgaccgcctcggagccgcccgacacgaaatacacgtgttcgaggccggccggcgcggcttcgacgagccggtcggcgagttcctcggccacgtcggtcgtgaagaacgacgtgtgcgcgtaggccagttgctgcgcctgccgcttgatcgcgtcgatcacgcgctggttgctgtggccgagacacgaaacggccgcgccgccgcacgcgtcgatatagcgtttgccggtcgaatcgatgatctcgatgccgtcgcctgcgacggcgacgggcaggtggcgcgcgggcgcgatggaaaacggtcgtcatgcgttgcctcatggatcaggatgcgtcgtgcgcgcgtccggacggcacgatgcgcgtcgcgaaacgctgcgtgccttgttggtgaatggtgacgtcgatcgacgccgcgccgatcgcgaacacggccgtggccagcgtattttcgtcgtcggggtccgcaggatcgtcgcggtagatcggcagcccttccggtgcgcgatcgccgagcacgcgccgcagcgcggcttcatcgatcgcgtcgataccgggaacgagcgcgtcgacgcggcgctggcggtcggccgacgattgcgtgacgatctgcgcctctgcttcacagcccggatgcacgagatggttcgcgtgcccggccagcgtcgccacgtcgacgaccgagcagcgcgcggcactcgcctcgatgctcagcagccgcatgtcgccggtcgcgccgagcgtatggtgaaagccgctcgcgcgcgcattcacgcgcagcacgtcggcggcctcgtcgagcgacgccgcatcgagcacggcgcgcgccaggatcatgcgcggcacgcccggcgcgggcgtcctgatccgcaggttgttgatcgcctgcacgatgccggcccggttcgcggcgaaggtgtgccccggcagcgagcccgggtagtagaaactgacgaagcccggcttgcccacgggctgcacgtcgacgagcaggcagcgctcgcgcaggaacggatcgccgtcctcgttgtgcgcgatccagcgcgtgccggccgcgtcgcgcgcggcaagcgtcgtgcagccgtccggcgcgttgtggatcagctcgccgcggcagttccacaggaagacgtcctcggccggccagccgacacccgccgcgatcccgtccagttccgcgacgagatcggggtacgcggccagcgccgcctgccgcagcgcatcgacgaacggatggccgcgccagcggcgcacggcctgccacgcgctgctctgccgcatgtacgcgtcgaacacgggacgggcgagctcgccgaggcgcacgccgatgtcgaacggcgcgccggcgatgacgggagaaagggaaagcggcatgtcggccatttcggtttcgttcaggacacgtgtttcaggaattccttcaggcgcggggtcggcggccggtcgatcaggtcgaccggatggccgtcctcggcaatgccgccctgatccatgaacagcaggcgcgtgccgacccgtttcgcgaagccgatctcgtgcgtgacgacgatcatcgtcatcccttcgttggcgagatcctgcatcactttcagcacttcgtggcgcaattccggatcgagcgccgacgtcggctcgtcgaacagcatcagccgcggccggatcgcgagtgcgcgcgcgatcgcgacgcgctgctgctggccgcccgacagctccgacgggtaatgattcgcgcgcgattcgaggccgaccttgtcgagcagcgccatcgcctggtcgcgtgcgtcggcgcgtgacgcgccgcgcacctggaccggcccgaacatcacgttctcgagcgcggtcatttgcggaaacaggttgaactgctggaacaccatgccggcttcgagccggatgttgcggatcgtcgtcgcattgccgcgcacgctctggccgtcgacgagcagctcgccgccggtgattttctcgagcgcgttgatacagcgcagcatcgtcgacttgcccgagccggacgggccgatcacgacgaccacctcgcccgcgtcgatcttcaggtcgatgtgcttcagcaccggcacgtggccaaagctcttcgacacgttccggaattcgatcatgctcatagaattctcatcctcttttcgacgagccgcagcgtcagcgtcatcgcgccggtcagcagcaggtagatgacggccacggcgctcagatctcgaccgcctggaaattgcccgcgatgatttcctgccccttgcgcgtgagttcgccgacgccgatcacgatgaacagcgacgtgtccttcaggctcacgatgcactggttgccgagcggcggaatcagccgccggaacgcgagcggcccgaccaccttcagcagcacgcgcggcatcgacaaccccatcgcgagccccgcttccgtcagccccttcgggatcgacagcagcgcgccgcgcaccacttccgcgagatacgcgccggaattcaccgtgatcgcgatgatcgcggccgtcaggccgtcgatgcggatatgcgcgagcagcggcagcgcgaagtacaggaacatcacctgcacgacgatcggcgtgccgcgaatcaactcgatatagacctgggcgagcacgttcatcgccttcggtccgtatgcgcggaacatgcccgcgatcatcccgacgatgaagccgcccaccagcccgaaaaatgcgatgaacaccgtcaaccggaccccgtccatcaggtccggcaacgccgcccagatcgccgaccaatcgaaattcacttgtcgctccccgttcgattcaagaccggcgcggccgcccggccacgccatggtgcgccgtcgcgcttacatcttcggcggctcggcgccgaaccacttcttgtagatctgcgcgtagcggccgtcggccttgatcttcacgagcgacgcgttgaccttcggcacgagcgggctgcccttcgggaaacccatcccgtacttgtcgccgctgaccggctggcccgcgaccttcaccttgcccttgccttcgttgttcacgaagaacagcacgttcggcgtgtcgtgcatcgccgcgtcgacccggccggcttcgagcgcgaggtaggcctggtcgatgttcgggaactggcggatctccttcggcttcaggtgcgccttgatccagtcgatggtcgcggtgcccgtcttcgcggcgatcaccttgccgttcaggtcgtcgatcgacttgaccgtcgtgttgccggtctgcaccatcgccgcgagaccgctgtcgtagtacggcgcggagaagtcgatcgccttcttgcgctcttccttgatcgtcatccccgacagcgcgacgtcgatgttctgcgtctgcagcgccgggatcaggcccgcgaaatccatcggctggatcgtatatttccagccctggtccttcgcgatctccgcccacaggtcgagatcgaagccgacatacttgtcgccctgcttgaactcgaacggcatgaacgacgtatcggtgccgacgacgagcgtcctggtatccgcgtgtgcgaggcttgcgccgagcgcggcaacgaccgcaacggctttcaggaaggaacggcgactcatggtttctctccgcatgattgagcgatgtgaccggccagccggccggcggtaacgacgacatcaagccgcaccgcaacatgcgatgtcgaattagaccttagtgcaacaagtgttgtcaaccgcgatactacgacaacaaaaacgcgcaacggataaatgcatcgaaacaaacccggggcacgcggcgcggataaatcggaggaaagggagtgtggcgcgggggcgaagcacccgggccgaacggcggtggcgcctgagcgtagttggcggtgaccgggccggcttgctgccccggggcgtcacgcacgagaggaggaggatggcgcgggcgcccggacaaccgtcgcggcccgcgcattgggtttgtcagcgtgaagcgtcggcgatcggttacggtgccgtgtcggggcggcgtccccgcgacacaggcaaccgccggcgtgactcgacgaatgttgcggcatgcgcgcggagctgccggaagcgaggcccgcgcgccgatgcgacgtcgcttacaccgccaccccgcttgcctgatgcgacacgagccgcgcatacgcaccctgccgcgccagcaggtccgcgtgccgtccggcctcgatcacgctgccctgctccatcacgaggatcaggtcggcattgcgcacggtcgacagccggtgcgcgatgatgatcgacgtgcgctgcgtcatcaggtcttccagcgccgcgcggatctgctgctcgctgattgtgtcgaggtgggacgtcgcttcgtcgaggatcagcacgggcgcatccttcaggaacgcacgcgcgatcgcgacgcgctggcgctggccgcccgacaactgcacgccgcgctcgccgacgcgcgtcgcgagcccgtccggcagccgcgcgacgaattcgccgagcgccgcatgctcgatcgcgcgctgcacgtccgcgtcggacgcatcgtttgccgcgagccggatgttcgcctccagcgtgtcgttgaacaggtaggtatcctgcgcaaccagcgcgatgtgctgccgcaggtcgtcgagccgcaggtcgcgcaggtcgacgccgccgagcgtcacgcggccctgctgcggatcccagaagcgcagcagcaggctcgcgaccgtcgacttgccggcgcccgacgcgccgaccagcgcgaccgtgctgccgggcgccatctcgaagctcacgcggtcgagcgcgggcacgctgcggcccgggtacgtgaaggacgtcgcctcgaagcgcaccgccggatcggcgggcagcgcatgcgtgccgtccgtcaccggcacgggctccttctccagcgcgcgcaggcggcgcgtcgacgcgatcgtgtcggcgagctggcgcgcgacctggccgatttcggcaaccggcatgaaggcagccaccgcgaccagcaccagcagcggcaacgactcgcgcggaaaccagccgcgcgcgcacagcagcgcaccgagcgccgcgacgaccagcccgccgagcccgctcgcgacttccagtgcggcgctctgcgtcgacaggtcgtcgagcagcctggcgcgttgcttccggtatgcatcgacttcggccacgaacgcttcgcgccggcgcgcgacggcctggaacgcggtcagctccgcgagcccctggatcgcctcggtcaggtgcgcgccgagctggccgagcgcttcgcgcgcgccggtgccgagccggtcgacctcgcgccgcgccagcaccggtgcaagcccggcccacaacaggaacggcagcagcgcgagcgcgagcggccacgcgaccgacgcgagcagcaccagcacggcggccggcacgagcaccgcgacgaacgcgggcgccagcgtatgcgcatagaaatactcgacggtctcgacgtcctgcgtcgcgagcgacacgagatcgccggaacggcggcgcagcagcccggccggcgcgaggcgttcgagcgtcgcgaacagcgcgatgcgcatttccgcgagcagccggtacgccatgtcgtgcgcgagccacgattcgagccagtgcagcacggccgccaccggcgcgatcacgagcagcgccgtgacgagcgccgggctcacatggccgcccggtaccgcaccgaccaccagcgcgccgatcacgccgacaccgatgaacgcgagcacgcggccgatcccgaacagcaccgtcagcacgaccttgcccgtccacggccgcacgaaccgcagcagcgtctggagcgtttccggccagccgatctccgccgcatcgtcgttcagcggccgcacttgcgggccggacgacgcgcgcgaggtcgtgccggccgtcgtcgccacgccggccgattcggcgaccgcttccagttgcggccccatcagccggcgatacgggccgtcacgcgcgatcagcgccgcgtgcgtgccctcgtcgaccacctgcccctggtcgagcaccaggatgcggtcggcgccgatcacactggacagccggtgcgcgagcacgagcgtggtgcgcccgcgcgtgagccggtcgagggcctgctggatcaacgcttcgttctccgcgtcgacggacgacagcgcctcgtcgagcagcaggatcggtgcgtcgcgcagcagcgcgcgggcaatcgcgaggcgctggcgctggccgcccgacagcatgagcccgcgttcgccgatgcgcgtcgcataaccgtccggcagcgccgagatgaaatcgtgcgcgttggccgcacgcgcggcggcgatcatgtccgcgtcgctcgcgtcggggcggccgagccgcaggttgtcggcgacgctgccgtcgaacagcgtcgcatcctgcgcgacgaccgcgatcatctcgcgcacctggccggcatcgagcgtacgcacgtcgcggccgccgatgcgaaccgcgccgccctgcgcatcgtgctgacgcagcagcaggcgcacgatggtcgatttgcccgcgccgctcggcccgacgatggcgaccgtctcgccttcgcgaaccgagaagctcagcgccgcgtgcgcgtcggcgcgacgccccggatacgcgaagctgacggcgtcgaacgcgatctccggccgcaggccctgcacgcgcggcgcatcggtgcagggcgtgtggctccgcgcgtcgagcagcgcatggatcgcattcgccgccgactggccgatcatcccctgatgcaacaccgaccgcaggtcgcgcagcggccggaagatctcgctgccggccatcagcacgatcagcagcgcctcgaggctcatgtcaccgtgccgcacgcgccacgcgccgaccgcgatcgcggcagccgcgccgaggccggtgccgagatcggtgaagagccgcgtcagcaggccgagcgcgagcacccagaacgtgctgtcggacagcgcgcgcgccttcgcggccagcttcgcgccgaacgccgtgccttgcccgaacgccttcagcgtcggcaggccttgcaccgcgtcgagaaactcctcgccgaacgccttgaacgcggccgagcgcgcgagcgccgcgcgcttgtcggcgcgatgcacgagttgcggcagcgcgagcgtgacgagcgccgcgaccagcaggatggcggccgtcggcacgtcccaccacgcgagcaccgcgaagatcatcaccggcgcgcaggcggcgatcacgagctgcggcaggtaggtgccgaaaaaggtctgcaactgctcgacgccgtcgacgacggccagcatcacgccacccgtgcgttcgccgctgaaccatgcggggccgagcgccgcgatccggtcgaacagccgcgcgcgcagcgtggcctgcacgcgcccggccgtgtgctgcgcgagcaccgtgcggcgatggtcgagccacgcgcgcagcagcacgcaggccgccgttgcaacgacggcttcgccgatgctgcgcgccggcgcgccggaaaagaccagcgccagtacgcggccgaggaacacgaagcgcaggatcccgacacccatcgcgagcagtccgagcgcgacggccgcggcgacccgccagcgcagccccgccatcattgcccatagtcgtcggtcgaaatacatgaagccctccggtagtgtctggttgcatttttcttgaccggatcgaggctacccgcgcggcccgcgcgcggcaaaagatgatttttcaacgggtgttgagtcaactacaatacccgccatgtcgcacctccctccccagcgcgttgcgggctttcgaggcggccgtccgcctcggcgggttcgcgcgcgcggcggtcgagctgaacgtgtcgacgagcgcggtcagccaccagattcgcgcgctcgaggaatcgctcggcgcgcggctgctcgaacgcagcacggggctcggcggcatcggcctcacgccggccggcgagcgcctgctgccggccgtcagcgatgcgctgtcgcgcctcaccgatgcctgcgccgagattcgcggcaccgcgcaacggctcaccgtctccgccaacgcgccgttttcggcaatgtggctcgcacgccgcctcgcggaattctcgtcgcttcatcccgaaacgccactgcacgccgtcgtgctcgacgacgaaccggatttcgcgcgcagcggcgtcgatctggcgatcgtgcacgtgcccgcgcaccggctgcgggacgacgacgacgtgctgatccgggagacggtgttcccggtgtgcagccccgagctgtttccgtacgcatcggggcacgtgtgccgctcgcggctgctgcaggagatgcacgagaacagccccgagatcgactggcacaactgggcatcggaattcggcttgccggacgacttcgagacgaagatcgtccgttacagcagtttcagccaggtgatcggcgcggcggtcggcggcgcgggcatcgcgctcggccgcgtgccgctgatcgagcccgaactgcgcagcgggcgcctggtgccgctggtgccgggcctcgcacgcgatgcgtcatggcgcttcgtgctgcgtcgcaacccgtccgcgcggcaccggctgctcgatccgttgatcgcgttcctgcgtcgcgaagccgaagccgaagccgcgccacccgccacgctcgcaaagatcgttgcgcccgcatccaacgacagtcacgcgcgcggcgcgggcggcgcctgacgggccggcgcacgaagccggcctcgccttgcctgccggcgcctacggcgcagcgaagaacaacgcgaccacgcacgccatcccgccgaaccacacgagcgaacgcagcgacgcccagttcagcaggtacatcagcatgtagacgatccggatcgcgacgaacgccatcgcgagctggtcgacgcgatgcacgttcgcgccgttgtgccatgccaccaccagcgcggccgtgaacagcgcgagcgcctcccatgcgttctggtgcgcggcctgcgcccgcgcgcgccagccttcgagcttcgccaggtagtcgcgcggcgcgcggttgtcgtaacccttgcgggccttcgcgagaaacgtcatcgtgaacggcaacagcgcgacgatgaacaggcacagctgggacgtcgtcatcaaaagtctcctcctttatcgttacattgatcaatgacaagatcgccgagagcttagcattgcgtcatgcccttcgcgcaccggttttctagacgggagactcggctgcgcggcctgtcgacagccgcgcccagccgggacgaacacaaaaatttccaccaaatcgtcgacaaatacgttaattaaaactggtcgaacaccaataagatagcgctcaacactggcccggcgtgttttcgcgccggactgccgaacccacgccgccgcgcgcgcccaacgacatccgatccgagacatcgccatgccccgtcccatcgtcgcccatatccgccctgacgccatccgccacaacctcgacttcatccgccgcaccgccgcgcaatcgcgcgtgtgggccgtcgtcaaggccgacgcatacggccacggcatcgagcggatctatccgggcctcgccgccgccgacggcatcgcgctgctcgacctcgacgaagccgtgcgcgtgcgcgagctcggctgggacaagcccgtgctgctgctcgaagggatcttcgagccggccgacgtcgagctggccgaccgtcatcggctgacggtgtccgtgcactgcgacgaacagctcgacctgctgatcgcggcaaagccgcggcagccgatcgacatccagctcaagatgaactccgggatgaaccgcctcggctaccggcccgacgttttccgcgcggcgtgggagcgcgcggccggcgcgccgtcgatcggcaagatcacgctgatgatgcatttcgcgaacgccgacgaaggccaggccgactggcagctcgaacagttcgatgcggccacggcggggattcccggcgagcgctcgacgtcgaactcggcggccgtgctgtggcatccgcatgcgcaccgcgactgggtgcggcccggcacgatcctgtacggtgcatcgccgacgggtgcgtcgcgggatatcgccgacacgccgctgatgcccgcgatgacgctgacgagcaagatcatcggcgtgcagacgctcgcgccggaagaaaccgtcggctacggccgccgcttcacggccgaccggccgatgcggatcggcgtcgtcgcgtgcggttatgcggacggttatccgcgtcacgcgccgaccggcacgccgatcgcggtggacggcgtgatgacgcgcgtcgtcggccgcgtgtcgatggacatgctgaccgtcgacctgacgccgtgcccggacgcgggcatcgggtcgagcgtcgagctgtggggcgaccaggtgaaggtggacgacgtggcggaagccagcggcacgatcggctacgagctgatgtgtgcgctcgcgcgccgcgtgccggtcgtgatcgtgccgcccggtgcgtcgagcgaacagccggcgctgcggaccggaagctacgggcgctgacccgggtcgctgcggcggcgcgcggccgcgcgctacgctgcaagtgccgcttcggttgcgggctgcctcgggcagcccgttcgttttccggtgtacgggacaggcccgggttacggcccttccgcgccgttcgcgggccttcgacgtcgcactacgaacgccacgtcggcttgcgcttctcgaggaacgcgtcgatcccttcgcccgcatcctcttccatcatgttgcgcgccatcacgtcgcccgcatacgcataggcttcgtcgagcggcaactcgcgctggcggtagaacatctgcttgccgtagcgcaccgcggccgggctcttcgcgacgatctcggcgaccttgcgtgcgacggccgcgtcgagcgcgtcctcgggcacggcctcgttgacgagcccccacgcggcggccgtcaccgcatcgacgaaacgcccggtcacgagcatgtcgaacgcgcgcttcgccgtgacgttgcggctcaacgcaacggccggcgtcgaacagaacagcccgacgttgatgcccgataccgcgaagcgcgcggtatcggccgcgatggccagatcgcacgcggcgacgagctggcaaccggccgccgtcgcaatgccgtgcacgcgtgcgatcaccggcaccggcaacgcgcgcatcgcgagcatcacgcggctgcactgcgcgaacagcgtgcggtagtaatcgagctcgggcgtgccgcgcatctgccgcaggtcgtggcccgcgcagaacgcccggccttcggcggccagcacgacgcagcgcacgtgcggatcggccgccagcgtatcgaacgcatcgtgcaggctcgcgagcatcgcctcggataatgcgttgaattgctgcggacgattcaatcgcagcgtgacgacgccgtcgtgcgcgtcgcgcaacaggatcggctcggcagtctcttgatcgggttccatgatgattcgctcgacgggattcggcagggttcggcacgacgtgaacgcgcggcggtgatgcacgcccgttcacggcacggtgttgaaatcgtcctccacattccgtgcggcgtccagtcgcgcggacgcgcatgcatgcgcagtagccggcgtgccgtcgtgcaacaaccacgcgactcgcgcatcaaccgcgccgttgcgcggccctcgccgtgcctgccgtccgcgcggcaagagcggccgtcgcataggcgatacaaccgaccgccgcgatcgcccatagggcggcggtcggattcggcagcagtatcgtcgcggcgctggcgatggccacaccgaacaggctgcctgcctgtctcgccgcattgaggaatcccgacgccacgcccgccgcgtccgcgggcacctgttcgagtacggtcgcgatcatcggcgccacggacagcgcggttccggtgccgaacgcggccatcgccgcccaggccaccggccacggcgcacgcagcgtcaacgcagccgcgagtgccggcatggccagcgccgccatcccgagaccgttcgccatcagccggaccggatggacacggccttgcaattttccagacagcagattgccgagcgacaggctcagcgcgaacggcaacagcgtcagccccgtctgccgcgcgctcatgccgaagcgcccgtgcaggtacaggctcaggacgaacagcaggccgaagtacccgacataaacgaggctgcccatcaggttcatcgcgacgaaggtgcgattgcgaaaccacgccagcggaatcatcggatcgcgagcacgccgttcgatgatgaccagcgcgccggcggcaagaccggcgaccagcagcgcgccccggacttccgccgcacccgggccgcgcgtcggcagctcgatcacggcaaaacacagcgcaccgagcgcgatcgcaccgacacactggccggcccaatcgaagtggcgcgcatgccgcgcgaccgacgcccgaacgagcacggccgccccggcaagagcgaccgcgccggtcggcacattgatcaggaatgcgctgcgccagccgaaatcgtccacgaggacgccgcccagcaccgggcccacggccaccgcgaccgacgcgatgcccgcccataccgcaatcgcccgcgcccgctcggcaggcacgtcgaaggtgctgcgcacgaccgcgagcgacgcgggtaaaagagcgcggcgcccatgccctgcacgaatcgcgcggccacgaggacggccacggacggcgcgaagccgcatccggccgatgccgcgacgaacagcgccagccccgcgagatagacgtgcttggcaccgaaccggtcggacagcgcgccgcccgcgagaatcagcgcggcgaaactgagcgtatacgcgtcgacgatccacgcgagcgccgcgaccgtcgcaccgagattcgcgcgcatcgcgggcagcgcaacgttgacgatcgtcgtatcgagtaccgccatgaacatgccgatcgcgacgagcgcaagcgtgaagcggcgttcgcgggccgtcgggcggcacgctgtcgtgatggatacgggaagggaaacgggatggcaatcgggcatgaaacctccaggcagatcccgggagtctagaaacggcacacgatgcagaaaagtgataatttcgcatttgcctgatgcagatatgcatctccactcccgccgccgccctgcccgatgacactgccgacccgtatgaactgggacaacgcccgcttcttcctggcccttgcgcgcaccggcacgcttcgcggcgccgcggcgcaactgaacgtcgatcaggcgacggtggggcgtcggatcgccgcgctcgaagacgaactctcggcccgcctgtttctccgaaccccggccctctatgtgctgacgaccgcgggcgaagcgctgctcgaacccgccgaaacgatggaacgggcgtcgctcaccatcgagcgacgcgtgatggggctcgacgaacagcttgccgggtcggtgcgcatcgccacgaccgactcgctcggcaagcgtttcgtgattcccgccatcgccagcttgcggcgcaggcatgccggcatcgacgtcgtgtgcgtgacatcggccgaaatcgccaatctcacgcgccgcgaagcggatctcgcgattcgcacgttgcggccggaatcaccggacctgatcgtcaggctgctcgggcatctcgaaacgggcatctacgcatcgcgccgctacctggccgagcgtggcgaaccggtcgcaggcagtgcgttcgaaggacacgacctggtgatgtaccagcagccggtggtgccgacgatgtgggacgccctgtgcggcgaaccgacgtcgcgcggccgcgtgatgttccagacatcgtcgacgatgatgctggtcgaggccgcgcttgcggggctcggcatagcggagctgccgtgcttccgcgccgaagccgagccggaactggtgcgcctcatgccccgacgatgcaatcatttcgacgtgtggctcgtcgcacatgccgatctctacaagaccgcgcgcgtgcaggcggtgatcgaagccgtcgtcgacgaattcgcgagcgccgcgccggacgcccggtaacgaacggggaccgcttcagcgcgcgaccgggagccgcccgctgcgccacccgcgcccgcccggccacagatgcccgacgccgccgaggaaaagacggcacccatgacaccaatggccagcacaccgccccggatcgcgccgaacgtattcatccgcgcagtcgtcgcgggcgtctgcggtgcggagcggacctcgaccgtcgcaccgtcctgcaagctgacgtcgccgacgcgcgtcagcccgcgagcttcttcaacgcgtcgagcaccgcgtcgcccttgaagggcttcacgatccagcccttcacgccggcggccttgccgcgctccttcatcgccgggctgctttcggtcgtcagcatcacgacgttgaccgtcgaattcgccaggtcgccgcggatcttctcgaccatcgtcaggccgtccatgttcggcatgttcacgtcgctgatcacgaggcgcacgccgggcgtcgccttgagcttcgcgagcccgtccttgccgtcgacggccgtcgcgacgtcgagcccgtgattgcgcaggaaacccgcgacctcgtcgcgcaccgtgcccgaatcgtcgaccaccagaatctttgccatgctgtattcccctttccttgttgcgacttcaacattcaaaacagttcgagttcacccgattcgaccatcggccccacgtcctgcaccgattcgcggaaatcctccggcgaccagctcaggctgaacacgaagcgctggtcgatgcagacggcgcgccccgacgccgggtcggtcatccggtacttgaagcagagctgcgggcagtcgccgccgaacgagatgaacttctgcttgtgattgacgacgagcggcacctgcaccggatggcgcgccagtgcctcggcgtcgccgagatagcggttcttgaacgcgccccacacgagattggtgagctcgccgagcacgctgttcacgtcgcggaaatccggcgcgcggccggcgtcgcgcgtgccgccgagcatgtcgagcagcggctgctcgctcgtctgcagcagcatgtagccgcggcaccacgcgctttcgagcgcgatcaggctgaacacttcgccgaagatgatctggtcgcgcacgatgcacggcgtttcgtgctcgatcgtcatgcccgggaacaggccgtcgaggcgcgcctcggtgatctccgagatgccgcgcacgagcgcgttcgggtaatcgcggccgaacaggtattcgtcgatcgcgcgcttgagcggcgtcatgtcgtccgcgacgtaggccgcgcacgcaacgcgcgcgagcgcctccggcaacccgtcgcgcgacgcctgcgcgtcgcggcgcaggatgatcggcagctcggggcgcagcgcatcgatctgcgtcgcgatgatcgcgctctcggccggcgagccgccgtaatcctcggccagcaggatcgcgccgaggtcgatgttcgagcgcagcaccttcagcagccggttgcgccgcacggtcaggccgaccaggttgtgctcgtcgcagaaacgcttgatcgcgtcggcgtgcgcgcgactgtcgtccagcacgagcaccttgctgacgggttggtctacggtcatctcaaggtttcctaatggtcggtcggggtcggtcagaacagttcgagctcgccgccggtttccatcacggccgtgtcaggcacatgaaaatcgaccggcgcgttcgcgcatacgcacagcgtcgcgccgacccgcacgtcgccgtcgagcgtcaggtcgtaagcggccacgtgatcgggcgacagcgcgcccaggtaatcgatgctcgatccgctcagcagataaggcgtcgacatccccaggtcgggaaacggcgcggtcagcgcctggttgatcgcgccgcagcacaggttcgcgacttccatgaacgcttcgggcagcggccgctggctgccggtgcccgcagtcgcgccggcgaaatggcggcgcgtcgcgtcgtcgtcgctgaagcgcagcgcgagcagcaggcggaaatgcagcgccgagatcgtcagcgccgcaacgtgctcgggcaccgtcggctttgcgcgcgacttcgcgtgcgctcgatcgtgcccgtcatgcgccgcgccggcggacggccggatgtcgcacgcaccgccggatgcgagccgcgtgcgcgccgcatcgaagaaaatccgctcgaaaccggctttcgcctgcgcgctgatcacgccgcgcctccgtcgatccgcgcatgcagttgcccggccagcgcctcgacggtcgccagcgcggccgtgatcatcttgccgccggcctggatgtcctggaacgtcgcggccgtcacgagatcgttgcggttcaggctgtcgcgatagctgttcgacagctgctgcgagcgcgcggccagcccgcgcacctcgctcgcgacgatcgagaagccgcgcccggccgtgccggcacgcgccgcctcgatcgacgcgttcagcgacacgatcgacacgtgcgcgacgatcgccgacagctcctggttcttcgtgcgcatgtcctggttctgcgtggtcagcgagatcatctgctcgtgccagcgctcgaaggtgccggcgagcccgcgcaggcgcgcggcttcgtcggcgatcttctgcgcgtgctgcgccagcgcggcgcgatcggccgacatggcctgcagcgcgtcgcgctgcgtgcccgccgcggaagtctcgcgtgccagcgcatcctcgagctgcgcctcgcgttgcgcccatgcgtcggccgcctccgcgtgcgcggacgccgcctgttcggcacgctcgccggccgcgtcgagcgccccgcgcaacgcatgcgcatcgcgttccagcgccgcgacgagccgcttgcgcatcacgcgaaatacgatcgccgccacgattgcgacgactgcgccgcccgccagcgcggcggccatctggatcatccacgcctgcacgatcacttcgtcactccacaacgccgacgtccgcgccgcgcgcgcgctcgtgagcggcaccgtcggccgcgaagcgggccggcaacgacacgatcgtttcgaatgcgcggtacggcgcgccgacacgatcgtcggtgaagcgcagcgcgatatcgccaccgtcgcgcttcaggaagttgcgcaccgcgtccatgccgacgccgcgccccgacacttcggtcacggcactcgcggtcgagaagcccggacggaagatcagctcggccaccgcgtcgtcggacagcgccgcgtcgtggtcggcgtcgatccagccacgctcgcgcgcgatgccgcgaatccggtcgagcgcgaggccgcggccgtcgtcgctcagcacgaaccacagctcgccgccgcccacgccgaccgcgatgtcgatcgtgccggatgccgccttgccggccgcgcgccgttcgtcggacgattcgatcccgtggtcgatcgcgttgcgcagcaggtgcatgaacacgttcttcagcgtcgcgacgatttcgctgcgcacgcgctggccatggctgtcgatatgcacgacgggcgccggcttgccgagttcggccgcgagcgacggcagcgactcgatcacgccgccgagcgcatcgccgatcccctgcgtgccgagctggctcagcatgcggcgtacggcatcgcgtgccgcgtgccagtcggccgcgttcgccggatcggcgccgtcgagcacgcgcaggctctcgctgatgtgcgcgcgctcgaccatcaggaagtcggcgccgccctgcaccgcgtcaccgctgcggcccaacgtgaccgcattgatcgtcgcgtagtgctcgacggcctcgcgcacgcgcgccaggtcgtccatcagcgcgtcgcggttccactcggggccgccgtccgcgcggcgcagcgagtcgtacgcctgctccgcttcgtggacgatgttcgtcagatgctggaggctgtacgtgcgtgcattgcccttgatcgtgtgcatgttgcggaacagcgccgcgacgatcgagtgatcggcgcgctcgtgctggcggatcatccgctcgttctcgctgaggaaacccttcgcgctgtgcacgaagtcgtggaacttgtcctggctgatcgacaggatctcgccgatcatctcgaggcggcgctgctgctcgccggcctgcgcggtcagctcgcggatctcggtcacgtcgcgcacacacagcatcaggcgcaccaccgtgtcggtctcgtcggtgatcgccgaccagctcaggtcgagccacttctcgcggccgtccggcatccgcttcgcgacttcattcaccagcaggtgctcgttgaactcgaagttcatgctgtcttcgccgagacacgcgtgcacggccgcgtcgacctgcgaacgcgcgtcagcgccgatcgccgaatcgtcgaacacgagcgccatcaggtcgcggccggcgatgtcgctcgtctcgaagatggtctcgaggtacgccgaatactcggcatgcacgacgccgccttcgacgacggtcaggatcccctgctgcatgttctgcagcatcgcctggatgtccgccgtcttctgcttgagctgcgcggcgttctcctggatcttctcgatcatcccgttgaacgcgacgatcgaatggccgatttcgtccatccggcccaccggcacgcggcgcgtgaaatcctggctcgccgcgatctcgctcatcgccgtctgcatcccgatcagcgggcgcgtgatctggcgatacagcagcaagccgagcgcggtcagcagcacgatcaccgtgccggcgacgcccgcgatcgcggttgccgtcgtcgagagcatcccgttcagcgcgctgatcgcgacgtccttctggcggttcttctcgacgcgcagcgtgtcgacgatgctttcgagttcgtcgcgatactgcgcgacgttcgcgaacaggtacgcctgcgccatctcgggcttgccgtcggccttcatcttcacggtgtcgtcgatcgccgcgaaatagttcgcggcgctgtccttcgcctgcgacacgagcccgacctgcgcctggccgaccgccgacttcgcctgcacgtcgagcgcggcgcgcagcgcggcctgcttcgccttcagctcgtcgcgcgcctgggcggcggtattcgcgtcgggcgcgtagacgagcgtcatcgtcgcgatctggatgttcttcacatcggcgacgagatcggccgacgcgagcgcgctcggcacgatgccctgggtaacctgacgcacctccgacgcgctcttgcgcgtctggtacacggcatagatgccgatcgcggacagcgcgaagaacgtcaggacgactagcagcgtaatgcgatgacggatggtcatgagtacagctccccgcagcgatccggcttcgatcgccgtttggtctattgaaagaatgtgagcgccgaattatcggggatggtgtatgacgctccgatgaccggaaatcaatcgttcattgataaaaatgcaatgaataattgcggcgaaagaaccctaaagtattgccgggatctgccgttaaccctctgcctcaaggcttctggcggtgcctgtgcgtgaccggaaatccgggatacggatattttgtttttatttattcgatccgcgaattgaccgctatatagctttcgcaaaacgtttgcgaattatcggcgaatccggttgaatgcgcgatttttattgccggtgaatcattggacggacggctgaaaacgataccgcccggggccgacgatgcgatgaactgcatcgtcggccgcgaggcgggcgtgaccggcggccggtcagtggctgctggcgcgggtcgccccaggcccgtttccgagcgcacctgctgcgcggcgaacgcgcccttctccgaccgtgcgcgcgcgctcgagtcaagcaccgagaacagccacacgctcacgaagccgatggtcatcgagaacagcgcgggcgacgtgtacgggaaccacgccgaacccttcggataaccgagcgttgcctcccacaccgacggcgacacgatggtcagccccaccgacgagaccagcccaaggaacccgccgatgaccgcgccgcgcgtggtgcatcccttccacatcatcgacaggaacagcaccgggaagttggccgacgccgccacggcaaaggccagcgacaccatgaacgcgacgttctgcttctcgaacgcgatgcccagcagcacggcgatcacgccgagcaccagcgtcgtgatgcgcgacaccttcagttcgtcggcgctgtcggccttgccgttcttgaagacggtcgcataaagatcgtgcgacaccgcggaggcgccggacagcgtgagcccggcgaccacggccaggatcgtcgcgaaggccacggccgagatgaagccgtagaacacgtcgccgcccaccgtcttggccaccagcaccgcggccatgttggccgtacccgcgccgcccttgatcacgcccttggccacgtcggacagttccggattggtcagcaccagcgtgatcgcgccgaagccgatgatgaagatcagcacgtagaaatagccgatccaggtggtggcccagaacaccgacttgcgcgcttccttcgcatccggcaccgtgaagaagcgcatcaggatgtgcggcaggccagcggtgccgaacatcagcgccatgccgaacgagatggccgagaccggatccttgatgaacccgcccggcgacatgacggacagcccgatacgggtcgcgtcgtccgtcgatttgccggcattcgcggcaatcgcggtcttgacctccacggcgtgggcgaacagcgcctccgggctgaagccgtactgcgcgagcaccatgatcgccatgaacgtcacacccgcgagcagcaggcacgccttgatgatctgcacccaggtggtcgcggtcatgccgccgaacagcacgtagaccatcatcagcgcgccgacgatcacgacagccacccagtagtcgagaccgaacagcagcttgatgagctgccccgcgcccaccatctgcgcgatcaggtagaacgccaccaccaccagcgtgccgatcgcggcgaaactgcggatcggcccctgctcgaagcggtagcccgcgacgtcggcgaaggtgaacttgccgagattgcgcagccgctcggccatcaggaacgtgatgaccggccagccgaccagaaagccgatcgaatagatcaggccgtcgtaacccgaggtcatcaccgcggcggaaatgccgaggaaggaagcggccgacatgtagtcgcccgaaatggccagcccgttctgaaacccggtaatgccaccgccggccgtatagaaatccgccgcggaacgcgtgcgggaagccgcccacttggtgatccacagcgtccctgccacgaacagcgcgaacaggacgatggccgtggtgttggtcgcctgcttggcggtctgcccgacatcgccgccgcccgcgacggccacgccgcacgcactcgcggccagcagcgcgaccagcatcgtcgaaagtgtcttcttcatcgggcgacgtcctgcaggatgtcctgcgtcagttggtcgtattcgttgttcgcgcggcgcacgtagatgccggtgatgacgacggtgaacacgatcaccgccatgccgatcggcacgccgacactcgttacgccggtgctcacgggcttcgcgagaaacgacttgtcgaacgcgatcagcgcgatgtagccgtagtagacgatcaacatcagcgcggtcagaaagacaccgagcgtattgcgccgtcgcttgagcagcgcgtacttcggatgcgcttcgatttttcaccaacccatcatgcatcgcctgtctcctggtttgctttttgaatgagttcggcgattctgaatagcgaagctgactgcgcgcttactcgctcttgcgcgcgcggcattccgggcactatggttttcctagcgggttcgggcgtggcggcggcatcgcctgcgcatgagcggcaggctcgatgcgtcgaattcattcctcccaggaaacaatcaatcgctcgccgacgattcacccgcccgcccgtacgctctagactgtcgcatcgttccctttccggattcacgcaatgaccgacgtcctgccgctgaccaccgatcccgagtcgggcctcccataccggctgcgcccggccgccggccgcccgttgcccgcctgttgctgctgcatggcgtcggcggcaacgaaaccaacctgctgaacctggccggcatcatcgatccccggatcgagatcgcgttcctgcgcggcccgctcacgttcgggcccggccagcatgcatggtttccggtgcgcttcggcccgaacggccccgaaatcgacgcggcccgcgcggacgaaagccgcattcagctgatcacgctgctgcgtgcattccgcgcccgcgacggcgcgggcgccgcattgccgaccgtgatcgccggcttcagccagggcggcatcatgagcgcgggcgtcggcctcacgtcgccggacgatgtcgccgccttcgccgtgctgtgcgggcgcatcctgcccgaaatcgatccgctgatcgcgccgcgcgatgcgcttcgcccgctccatgcgctgatcgtgcacggccgcttcgacgacaagctgcccgtcgcatgggccgacaccgccgacgcgaaactcacggcgctcggtgtcgcgcacgatacgcggctgtatgatgccggccacgagctgaccgcggagatggccggcgatttcggccgatgggtcggcgaacgcgccggcttgaactgaccgtaccggcacgccgggcgcgcccggcgtgtaccgtcaggcgccccgcgccgaatcggcgacggcacccgtggcgacggacgtacgcgcattcgccgcctgttctcgcgcggcaccgcgcttcgccagcttccagcccaccacgagtgcgagcacgacgaccggaatcatcgcgatggtccacgtgccgcccggatagtcgaacgccatcagcaccagcacgccgacgaggaaggcgagcgtgagccacgacgtgaacggcgcgccgggcatccggaacgacaccgccttcagctcgccgcgatcgaccgcgcggcggaacaggatctggcacatgacgatgaagccccacgtcgtgatgatcccgagcgacgccatgttcagcacgatctcgaatgcctgcgccggcacgatgtagttcaacggcacgccgatcgcgttgatcgcgaccgtgatcaggatcccgccgtacggcacgccgcgtgcgttcatccgcgacacgaagcgcggcgccgatccgcccatcgccagcgagcgcagcacgcgcccggtcgaatagaggccggagttcaggctcgacagcgcggcggtcagcaccacgacgttcatcacggtgccgacgtacggcacgccgagcttgctgaagaacgtcacgaacgggctttcgtgcgagctgtatgcggtccacggcagcagcatcgtcaacagcacgacggagccgacatagaacagcgcaatacgccacatcacgctgttgatcgccttcggcagcaccttgcgcgcatcggccgtctcgcccgccgcgacgccgacgagctcgatgctcgcgtacgcgaacacgacgccctgcacgatcagcacggccggcaggaggccgtgcggaaagatcccgccgtgatccgcgaccaggtgaagccccggcatctgcccggcgaccggatggccgctcgcgagaaacaccgcgccgaccgcgaggaacaccgcgagcgtccccaccttgacgagcgagaaccagaactccatctcgccgaacaccttcacgccgatcatgttcatcaccgacacgatcccgagcgcaccgagcgcgaacacccactgcggcacgtccgtgaacacggcccagtacttcatgtagatcgcgaccgccgtgatgtcgacgatgccggtcgtcgcccagttcaggtagtacatccagcccgcgacgaacgatgcgcgctcgcccatgaactcccgcgcgtacgacacgaagctgccgctggtcggccggtgcatcacgagctcgccgagcgcgcgcatgatcaggaaggcgaacacgccgcagacgagatacacgagcgcgagcgcgggccccgcgctctgcaggcgtccacccgcaccgaggaagaggccggtgccgatcgcaccgcccatcgcgatcatctgcacgtgccgcggcttcaactgcttcgcgtaacctgcttcgtgcgatgcaaacatcgcgtcggggtcggcatgacgggaatccgcgccgccggccggaccggccgggcgctcgctgctgtggttcatcgtgagtctccgtagtttcttgatgtgtcgcgcccgcgcgcgctgatgaaatgacggcccgccgggcgctcaacgcgcgcgccggcggccttcagccggcgtcaaagcacgcgcggccggatcagcgcttcgggctgaagcgcttcgtcgacctgcgcatcggtcatccactggcgttcgagaacgacctcgcgaatcgacttgccggtcgcgtgcgcttcggccgcgacggcggtcgcgcgcttgtagccgatgtacggattcagcgcggtcgcgagcgcgaccgagcgctccatcgtttcgcgcagccgctcggggttcgcggtgatcccgctcacgcaacgctgcgccagcgtcgtgcaggcggccgtcaggtggctgaagctgcggaacagcgcgctggcgatcaccggctcgaacgcgttgagctgaagctgcccggcctcggcggcgaaggtcacggtcaggtcgttgccgaacacctcgaacgcgacctggttgacgacttccgggatcaccggattcaccttgccgggcatgatcgacgagccggcctgcaccggcggcaggttgatctcgccgaaccccgcgcgcgggccgctcgacagcagccgcaggtcgttgcagatcttcgacagcttcacggcgatccgcttgagcacacccgagacctgcacgaacgcgccgcaatcctgggtcgcctcgatcaggttcggcgcggtgctcaggtcgagcccggtaatgcgccgcagcgccgccagcgccttctccgcgtactgcggatgcgcggtgatgcccgtgccgatcgcggtcgcgccgaggttgatctcgcgaatcagccagccggcttcctgcaggcgtgcaatgtcttccgtcagcatcaccgcgtaggtcgagaattcctggccgagcgtcatcggcaccgcgtcctgcaattgcgtgcggccgagcttcagcaggccggcgaacgcgtcggcccgctccgcgaacgcatcgcgcaggcgcgccatcgcttcgagcaggtgctcgagcgcgaagcaggtcgcgacgcggatcgcggtcggatagacgtcgttggtgctctgcgcgagattgacgtgttcgttcggatgcaggtattcgtactgcccgcgcgcgtgccccatgagttcgagcgcgcggttgcagatcacctcgttcgcattcatgttggtcgacgtgccggccccgccctggatcacgtcgacgacgaactggtcgtgcaggcgcccttcgcgaatctcgacgcacgcggcggcgatcgcatcgcggtacggtcgcggcagcagcccgagctcgcagttcgcgtcggccgcggcctccttcacggcggcgagcgccatcacgaggtacggcagcgacgcgatggtgcggcccgaaatgtcgaagttctctttcgcgcgcagcgtatggacgccgtaatacgcgtcgtccggaatacttcgtttgcctaaaagatccgcttcgacgcggaagccgttttctgtcatcgtgccctcctggatgtctcgtaccgctcgtcgttcgccgcttcccgacgcgacgggttcgcattctatgcctttgcaaaaacaagctcgcttatgtattatcgaaagcggttttgcgtgggacgcaacagcgagaatcgaatgaaaaaggcgcgagagaaaccggcatcgatcacatgggcgcgatgcgcgcgttcgtgagagtggtcgaaacagggagtttttcggcggtcgcgaaggagatgcacgtgtcgacgtcgacggtcgcgcgcaaggtcacggcgatcgaggaggcactcggcgtcgcgctgctgcaccgctcgacgcacagcgtcacgctgaccgaggccggccacatctacctggaacgcgccgtcacgctgatcgccgatctcgacgacacgctgcgtgtcgtcgccgagctgaatgcgcagccgagcggcccgctgaagctcaccgcgccggttgcgttcggccgccgccatctcgccccgctggtcgcgccgtttctcgcgcgctacccgacgatccagctcgacgtgcgcctcaccgacaaccacaacgacctcgtggccggcggcttcgacctcgacattcacgaaggcgagaactacctggacaacctcgtcgtccaccgcctgtcgcgcaacgacagcatcctgtgcgcaacgcccggctatctcgaccgctgcgggcgcccgtccacgccggacgacctcaagcaacacaactgcctgcgctacgtgcaccccgaaggcgatccgcgctgggagctcgtgaacggcgacgcgcatcacagcctgctgccggtcggcaacctcgtcaccgaccattcggagctgctgctcgaagcgacctgcgcggggctcggcatcgcggagttcgagatctggctggtgcgcgacctgctcgcgagcgggcggctcgaagccgtgctgccgcgctaccggctgctgaaccggctgacgggcgaatacatctacatcgcgtatctggcgaaccggcgcagctcggcgaagctgcgcgtcctgaaggactttctcgcggaacatctcgcgcacatcggcgagctgtcagcgctggagctggggaagattcgcggcgcgcgcacgtagcgcccgcgttcacgcccgcgcctgccagccggccggcaggcatgtgcccgccgccgcgctcggcccgcagcgcgggccgtcggcagcggcgcatccgcgccggtcaggccggctgcaattcgaacgggaacgtggcgtgcccgatctcgacgccctgcgtgttgcgcatcggcggccgatggaaagcggccagttgcgcgcgctgcccggccgtgccgatctgcagccgctcgaggagttcgctgacgaccatgtagagcacgtcgagattgccgtcctcgatcttcaccgagatgccgagcgcgccatcggcgcccagttgccgcgtgcgcgccgacgcacgcacgccgatcccgtagcacgcatcggcgccgagcttgccgaccacctgcccgtcgaacgctttcatcagcaccgtgcaatagcgcccgtcgccggccaccagttccggatacgcggtcatcgcacgatgaatgcgcgccagcgcacgcacgcgatcgctgattgcgtcaccgcccgcctccaccgtatccgccccgtcggccagcgatgcgtacaggcgcgccagccggtccagcggaaacgccggcgtcggcaggttgcacccgtcgatcgcccagcccacttcgtcctcgcgcagcccgcacgcatcggccatcacctgtttcacgcgcacctgcatcggatgctcgggcagatggtaatcggcgatcgcggcgccgatcgcctgcgcgccggccagcatcccgacatgcttgcccgaacagttgctgcatacgccggtcggcgtgtagtcgcgcttgatccacgcgcggtacaccgcgtcggacaacggcggatggccgccgcaacgcaagtccgattcctgcgcggcgacttttgcgagcatcgcgcgcgtgcgttcgatatgccggtcctcgctgctgtgcgacgcgcacatcagcgcgatgtccgcatcgtcgaagccgaagcgctcgggcgcgcccgtctcgattaccgacagcgcctgggccggcttcgccgccgaccgcgcgagcgtcatccggaacggatcgccgaaccgggccagcagcctgccgcgtgcatcgaccaccgccacatcggcgacgtgcgtgttctcgatcgccttgccgcggtacgtgacgactgctgcgcgttgggtgtccatcttatgttgtctccatgctcggggcctgcttgccggggcccttccaaccggtacggcagtgtagcgagtcgccgcgccacgcgccggcccggccatggaaagcggtgttgcatgcgacgcaaaggcgatcgcgccccacgaagacctgaccgaattagtacaaaaaccattcaatcgtttacagaattagtaccaatccgtagaattgcgaccgcaaacgcgaatcatacgcatttacattgacgttttccgatgttccgcactgcccggcctgcatcgagaagacgcgcctgctcaccgaatcttctgctgcctctcgatatgcccgcccagttcaagacgaggcctcgcgccctcgtgtcggcgctgacctgctccgttttcctgaccccgctgctcgcctccgccgaaacggcaccgcccccgccgccgaccggccggccccgtccgccgacgtgcaggcgacgctgccgacgatcacgatccagtcgtccgcgccgtcggacatgcaggtgaagcaatcgccgtcgtacaagttcaccgcgccgctgctcgatacgccgcgctcggtcacggtgatccccgagcaactgatcaaggaaaagaacgtcacgtcgttcgcggacgcgctgcgctcggtaccgggcatcacgttcctcggcggcgatgcggccgcgaacccgtcggccgaccgcccggtgatccgcggcttcgaatcgcgcaactcgatcttcgtggacgggatgcgcgactcggggctgcagaaccgcgaaacgttcgcggtcgagcagatcagcgtgatcaagggccccgattcggtctatgcgggccgcggctcggtgggcggcagcatcgacatcgtcacgaagacgccgaagaacgacgacttcatcaacagcagcatcggcttcggcaccgacggctacaagcgcgcgacggtcgacgcgaaccgcaagatcaacgacacgacggccgtgcgcctgaacgtgatgggtcacgacgcgaaccaggccggccgcaacgacgtgtacaacaagcgctggggtgtcgcgccgtcgatcgtgttcgggctgaatacgccgaccacggtcacggtcagctattaccacatgaactcgtacgacatgccggacttcagcgtgccgttccgcgcgtcgggcggcacgccggtgccgaccgatcgcgggcagttcttcgggttgaacacgcgcgactaccgctacgggcagaccgacaccgccgaagtgcgcgtcgagcacaagctcaacgacgactggaagctgaagaacacgacgatgttcggccgctcgacgctcgattacgtcgcgacgaacccgcagatcctcgcatcgaacccgaacatgctgagcctgcaggcgaagagcggcaagtacgcgctcaacggcttctcgaaccagaccgaggtgaccggcagcgcgagcctgttcggcatgaagcacacgatgacggccggcgtcgagttcagccatgaacaggcgcgctacgagggctacctcgtgtcggattcggccggccacaacatccgctcgggcggcccgtgctcggtggccggcaactgcacgccgctcgcgggcggctggaacccgaacatgccgtggaccggcagcatcgtgctgaacggcgacaagggcttcccggcgcgacgacgaacacgcgcaccgacaccgtgtcggcgtacatcttcgataccgtgaagctgtccgagcgctggcagttcaacacggggctgcgcttcgaccgctacgacacgaccggcaagcaggccggcgtcgccgacctgtcgaacacgtcgaacctgttcagctaccagttcggcctcgtgttcaagccggtgagcaacgtgagcctgtatgcgtcgtacggcacgtcgtcgaacccgccggggtcgaacggcggcctcggcggcggcaccgaccagatcaccgcgacgaaccaggacctcgcgccggagcgctcgcgcaacatcgagatcggcgcgaagtgggacgtgctgcgggatcaactgtcgctgacgtcggcgctgttccagaccgagaagaccaacgcgcgcgtgagcgacggcctcggtcacacggtcaacgcgggcaagcagcgcgtgcgcggtttcgaattcggcttcgcgggcaacatgacgccgaagtggcacgtgttcggcggctactcgtacctgaacgcgatcacgaccgacgcgggccccggcaacccgggcgcatcgggcctgccgatggtgatggtgccgaagcacaacttcacgctgtggacgagctacgacgtgatgccgaagctcacgctcggcgccggtgcgacggtgatgagccagacctatgcatcggtgtccgcgacgacgaagaaatggacgcccggctacgcgcgcttcgacgcggccgccacctggcgcgtgaacaagacgatggacgtccagctgaacgtgcagaacctgttcgacaagaagtattacgcgagcgcgtacccgatctacgcgacttgggcgccgggccgttcggcgatggtcacgctcaacttctatcagtaacgcggtcggcggcgggagggcgtggtacgccctcctcgccgcgctcaccacggcagcgaatacgtcttcacgttcgtgaagctcttcatcgcttcctgcacgccttccttgtaccccagccccgaatccttcacgccgccgaacggcgtcagctcgagccggtagcccggcacttcgcgcacgttcacgctgccgacttccagctcggtgatgaagcgcgtgatgtgatcgaagcgattcgtgcacaccgacgacgacagcgcatagtcggtgctgttcgacatccggatcgcttcgtcgatgtcgcggaaacgcatgatcggcgacacgggcccgaacgtctcgtatttcacgagcggcatgtcgggcgtcacgcgatcgatcaccgtcggcgaatacagcgcgccgtcgcgcacgttgccgaccagcagtcgcgccccgcgcgcgatcgcgtcgttcacctgccgctcgcagaacttcgcggccgcttcgtcgatcaccgtgcccatgtccaccgacggatcggccggattgccgtacgaccacgcacgcgtttttcaacgaccagcccggtgaagcgatcggccaccgactcgtgcacgagcatccgcttgatcgcggtgcagcgctgccccgagttcctgtacgaacccgacaccgcgagcgtgctcgcttcgtcgagatcggcgtcttccatcacgatgatcggatcgttgccgccgagttcgagcaccgcgcgccggtagcccatccgcgccgcgatcgacttgccgatcgagacgccgcccgtgaacgtgatgaggtcgatcgccgggttcgtgatcagttcgtcggcgatctccttcgggtcgccggtgagcacctgcagcatctgcggcggcaggcccgcttcgtacaggatgtccgcgaacaggtagcacgacagcggcaccttctcggacggcttcacgacgatccggttgttggtcgcgacggacggcacgatcttgtgcgcgacctggttcatcgggtggttgaacggcgtgatcgccgaaatcacgccgagcagcggatcgcgctgcgtgtacacgcggcgcttcttgccgtgcggggtcaggtcgcacgagaagatctgcccgtcgtccttcaacacttcgccggcgccgaacgtcagcacgtcggccacgcggcccgcctcgtacgtcgaatccttgatgcacagcccggcctcggcggtgatcagcgccgcgatctccgccgtgcgcgcacgcacgatgtcggccgcgcggcgcaggatcgccgcgcgatcgtggcgcgtgagcgccggctggtatgcatgcgcggccgcgaacgcgcgccgcacgtcgtcgagcgtcgccttcggcacggtgccgaccagcgcgccgtcgtacgggttgcgcacttcgatcaccgcgtcgcgccacacgcgctgcccgtcgatgcgcaacgcttcgtgccgcacgtcggatgcgggaatcggcttcaggaccgtgctcatgtcgtctccgttgtcgtgatgcgtgatcgtggccacgctaccgggtgccgcggcgcgccctaccgcaccacgaccagcccttcgtattcgaggcagcggcacaacgtcgcccatgccggcgagtcgggccactcgcgcgcgccggtgtcgatgcggatcggccgtccgtattcgcgcgatgcacacgccagcagcgtatgcgcgatgccgctgcgtcgataggcgggttccacgtacaaccgcgcaagcgacggcgatcgcgcggcaccgccgccgccgtcgtcgatgccgagttcgccgatcgcctcgtcgtcgcgatacgcgaccgccgtcgcgcgcgtgtcgtcgaacacgatgcggatcacacgctcgcagcgatccctgaacacgacgacgtgcatggcctcctcccttcgcatcacgatgcgggcgaacgcgatgcgcgcacgccctcccgcgcccgcgtaccgggagttatccggatcgtccaggggcgacgagttgagtatcgtcttgccacgtcggcgcgcagtagtgccagacgacacctttcattgagtccacatccgcggcgcgacgcgcgtattctcgcgaaaccgcgcctctcgcgggccacgcgcaccccggcgcgcaccgcctcgcgtttcccgtaccgatcacaggaggaagcatgccgagtcgtaccccgaccgccctatgggcccagcagttccggcggtcgtcggcgtcgagcctgcaggaccagatccggcggatgctcgtggccgcgatcctcgacggccagctcgcccccgatgccgcgctgccgtcgagccgcgagctcgccgaccagctcggcgtcgcgcgcaacaccgtcgtgctcgcgtaccagatgctcgtcgaggagggctacctgatctcgcgcgaacgcagcgggcacttcgtgaacccgaagatgctcgagggcgtgcccggcttcgcggcggccaagcccggcgagaaaccggacggcgacgacacgccgggccgccctgcgtgggaaaagcgcatcgcgcatccgccgtcgaggcagcgcaacatcgtgaagcccgcgaactggcagcactacgaatttccgttcatctacgggcaattcgaccagtcgctgtttccgaccaacgactggcgcgaatgctgcctgaaggcgctgtcggtgatggagatccgcaactgggcgcccgacctgatcgagcgcgacgacgaatcgctgatccagcagatccgcacgcgcgtgctgccgcggcgcggcgtgttcgcgatgcccgacgagatcgtcgtcacgaacggctgccagcaggcgctgtacctgatcgcggacctgctgtgcggcaagcacacgacggtcggcttcgagaatcccggctatcccgacgcgcgcaacatcttcgagaaccgcaacgcacggctgctgccgctgcccgtcgacggccacgggatcgcgcccgatgcgctcgccgatacgctggcgcgctgcgactacgtgtacgtgacgccgagccaccagtgcccgaccaccgcgacgatgccggtcgaacgccgccgcgcgctgctcgactgcgcgcggcagcacgatttcgtgatcgtcgaggacgactacgagagcgagaacacgttctccggcacgccgcatccggcattgaagagcctcgacacggccgaccgcgtgatctacgtcggcagcctgtcgaagacgttcgcgccggggctgcggctcggctacgtggtcgggccgcgcgagctgatccgcgagttgcgcgcgctgcggcggctgatggtgcgccatccggtcgcgtatatccagcgtgcattcgcgacctttctcgcgctcggtcatcacgacgcgctgctgcgccggctcgcgcatgcgtacagcgaacgctcgcaggcgctgatggccgcactcgatgcgcatctgccggaagcgcgtcacgtgcgtgtgacgggcggtgcgtcgtgctgggtcgagggccgccgtggctcgatgccacgcgcctcgcgaccgacgcgcaggcggccgggatcctcatcgagccggggaacgtgttcttcatggacgatacgggcgacgcgcgacgctgcttccggatggggttctccgcgattccgctcgagcggatcgagcctggtgtgcgggcgctggcgcagtgcgtgcgggcgcagaagccgggcgcctgaccggatgcggaagggcgtcgcgccaccgattgcgtgaccgccctcgccctcgtgcacaatcacgcagccggaaacgatcccgactttcgttgcgcgggaagcatgccgccggtttcgcgcgcgtcgctcccgtgcgatgcgcgcaggtgccgatcgtaacgatcgatcgggttgtgctgccgggcagcaggctgcctttcgggtagaggtcgcgttcacgtgcgcacgcaacgtgcgccgcccccgatcggcacgttgtttctcgccttgtcgtagaaccctgcattcgccacccgctcgctgaatccgttgcacccgccgataccgcgccaccgcctgcacatcgtttccactcgtttagtaaatctaataaaaacattacaaatccgttattcggattgacagcgaattcatacgaatcctagtgttacgacgcaacacgacagcaacaacccactgcgatcccggattcgatcgtcgggatcgtcaaggcaaaaaggcatctccgactggaggggacgatcatgagtcgattcacgacgctcgcggcgttgctggccgcggcgtgcgcattgagcgggtgcggaggcggtgacggcagcgacggaacggcggcgtcgatactggccgcacatccggcggaatcgtcggccggtgcggccgacacgaccaacctcgacgacaaccgcagcctgtcgttgacgcagtatgtcgacccggtgatcggcacgctcgcgagcaattcgccgaacccggtgccggcgggacaggccggcagcgtcgtgccggccgccgggctgccgtcgggcatggtgcaatgggcgcccgacaccaacaccacgccggcgccgaacgacagcaaggaaccgaactcgccggccggctattactacgacctccattcgatccagggtttcagcgtcacgcacatgccgggtgccggctgcagcggcaacaacggcgaattcccggtcatgccgaccaccgacgcggcccagctcgttccgaccttcagtcatgcgaatgaaacggcccggcccggctactactcggtcgcgctcgattcgcagatcaaggtggaactgaccgccaccctgcgcaccggcttcggcaggttcacctacccggccggcaaacccgcgctgctggtactcgacgcgacgcgcaccaatacgaagacctcgactaccggcgcgattacgcaggtttccgacagagccatctcgggcagcacgatcggcggcggcttctgcggcaactcggtgccggtacccgtctacttctatgccgcgttcgaccaggcgttcacgtcggcgtcgatctcgcacggcgtggcgcagctcggcttccgtcccggccaggcggtcaggatgaagatcggcatttcgtacgtcagcgccgccaatgcaaaggccaacctcgacgcggaaaatcgcggctgggacttcgagggcgtgcgcacgcaggcagacagaatctggaacgaccgcctcaacgcgatccgcgtggcgggcgggacgctcgacgcaaagaagaagttctacacggcgctctatcacgcgctgtgggcacccagcatcttcagcgacgcgaacggccagtacatcggcttcgacaataccgtgcaccaactcgccaaaggccagaacgcgcagtattcgtcgttctcgggctgggacatctaccgttcgctgatccagctcaagtcgatcctcgcgccgtccgaaaccagcgacatgatccagtcgctggtcaacgacgccgatcaatgcggcgcgattccgcactgggtcaacgacaacgtcgaggacggcgtgatgccgggcgatgccggttcgctgatcgtttcgagcgcctacgcattcggcgcgcggcgcttcgatacgcgctcgcgctgcagcacatggtgaagatggcgaacatccccggcaccgcctgcaacaacgtgaccaccaacggcggccgcgcgagctacctgcagggcggctacatcaccggcggcgagtgggggcaggcttcgtcgacgctcgaatacacgagcagcgacttcgcgatctcgcgctttgccggcgcactcggcgataccgccacgcagcgcatgctgctgagccgctcggcctactggcagaacctgctcaacaccgcgctgacgccgccgctgatcgcggcgcggcaatcgaacggcgcgtggatacccgaaacgccgggcagcggcgacaactacgtggaaggcaatgccgaacagtacacgtggatggtgccgtacgacgccgccggcctgttcgcgcagctcggcggcaacacggccgtgacgtcgcggctcgaccagttcttcacggtgctcaatgccggcctgagcctgccgaatttctacatgggcaacgagccgaccttcgaagtgccgtggctttacaactgggccgcgcaaccgtcgggcacgcagcgcgtggtgcagcagatcatggccagcgcgttcggcaccggccccgacggcttgccgggcaacgacgacctcggcgccgtgtcgggctggtatgtggggcgcgctgggcctgtacccgcagatccccggcgtcgcgggcctggcgatcggcagcccgcagttcccgcagatcgacgtgcggctcggcaacggccacacctggcggatccgtgccgcaggcgcgccggcctcgagctacgtgcagtcgctgtcgatcaacggtcgtgcccaccctgccgcatgggtcgcctatgacgacatcgccgatggtgcgacgctgcacttcgcgatgggcagcgcaccgtctcgatggggcggccagacgcagccgccgtcgttcggcgtaccggtggcgctcaacgcggccgacagctacaacaatcgcggcttcagcatggacggtgcgaccaataccgacggccagggcgcggacttcgacggcagcctgttcagctactcggtcaatgcgctcggcgcggcgggcgtgcagcccggcaaaccgttcgcggtggccggcgccaccgtgacggtggcgggcgggccgctcgctcgacaacaccgtgaccgtcggccagaccgtgatgctgccgccgggatcggccggcaccggcgtcgtggtgctcggttcgtccaacaacggcccgagcagcggatcgcgcaactgaacttcgcggacgggtcgagtcaggccgtcacgctggccttcgacgactggaccctgaacggcggcagcgcgagcccacgctcgacggtggccgtcacgatggcctatcgcaatgccggcaacggccagcaggacaacgtcaagacctacatcttcgcgcagaagattccagtgccgcccggcaaggtggtgacgagtatcgtgctgccgcggcaggtcagcgccggcaagatgcacgtgttcgggatcggcatgacggcatcgtgatgcccgcatgaccggcggggcacatcgcgtgcgacgatgtgcccccgcctcctactgctcgcccgcgtcggggtcccgccccgatggcggccgaatcgctcgtccgccattttccgtgcacgccacgctcaccggcctcgttcgccgtcgcgtcatgcgagacgcgcacgacaccggttcaagccgtgcgttccaccacgtcgggaacgccgtgaacgcgcgaacgtgcccggcatccgccgctggcccaaccgaatccccgaactggcgctaccgccaaaaacgagcgctcactaacgtgtcgataccgcgtgccgcatgcgcgccagcgcctcgcgcaccgcccaccattcgacaggagacacgttatgtccgacacgctcaccgcccccgtcacggctgccatgctcgcggcgttttccgacgcattcaaccggcatgacgcgaatgcattgatgggcttcatgaccgaggactgcgtattcgacgcggccggcggccccgacatccacggtacgcgcttcgtcggccgcgacgccgtgcgcgccgcgttcgaagccgtgttcaagaccttccccgacgcgcactggggccgcggccgccactacgtgaccggcgagcgcggcgtgtccgagtgggtgttcaccggcacgcacgccgaaggctggcgcatcgaggccgaaggctgcgacctgttcgaattccgcgacgggctgatcgcagtcaagcgtgcgttccgcaaggaacggccgaagcagccggcctgagcgcaccactcggggccaccgtaccccacacgcatttttgaaacgaatcatttcatttcattccacatttccccgcagcaggtggaatgacttgaccggcttttcccggcaaatagcatctggaacgaaacgttccgttaattgaacaatcggagacaacccatgagcgaacaatccacttccctgcgtgcatcggccagcggtccgcaggacatgacgccgtccgaagccttcgtcgagaccctcgcggccaacggcgtgaccgacatgttcggcatcatgggctccgcgttcatggacgcgatggacatcttcgcgcccgccggcatccgcctgatcccggtcgtgcacgaacagggcgcgggccacatggccgacggttatgcgcgcgtgtcgggccgccacggcgtcgtgatcggccagaacggccccggcatcagcaattgcgtgacggcgatcgcggccgcgtactgggcacacagcccggtcgtgatcgtcacgccggaagccggcacgatgggcatcggcctcggcggtttccaggaagcgaaccagctgccgatgttccaggagttcacgaagtaccagggccacgtcacgcacccggcgcggatggccgaattcaccgcgcgctgcttcgaccgcgcgcaggccgagatgggcccgacccaactgaacatcccgcgcgactacttctacggcaaggtcaaggtcgagattccgcaaccgcgccggctcgatcgcggcgccggcggcgaacagagcctcgacgatgcggccgcgctgatcgcgcaggcgaagttcccggtgatcatctcgggcggcggcgtcgtgatggccgatgcgatcgaggaatgcaaggcgctcgccgaacggctcggcgcaccggtcgtcaacagctacctgcacaacgactcgttcccggcgaaccatccgctgtggtgcggcccgctcggctaccagggctcgaaggccgcgatgaaactgctgtcgcgcgcggacgtcgtgatcgcgctcggctcgcgcctcgggccgttcggcacgctgccgcagcacgggatggactactggccgaaggacgcgaagatcatccagatcgacgcggaccacaagatgctcggcctcgtgaagaagatctcggtcggtatctgcggcgatgcgaaggcggcggccatcgcgctcacgcaacgcctcgaaggccgcacgctcgcgtgcgacggctcgcgcggcgatcgcgccgaccagatcgcgaccgaaaaggccgcgtgggaaaaggaactcgacgactggacgcacgagcgcgacgcgtacagcctcgacatgatcgaggagcagaagcacgagaagccgttcagcggcggccagtacctgcatccgcgccaggtgctgcgcgagctcgagaaggcgatgcccgaggacgtgatggtgtcgaccgacatcggcaacatcaactcggtcgcgaacagctacctgcgcttcaacaagccgcgcagcttcttcgcggcgatgagctggggcaactgcggttatgcgttcccgacgatcatcggcgcgaaggtcgccgcaccgcatcgtccggccgtgtcgtatgcgggcgacggcgcgtggggcatgagcctgatggaaacgatgacctgcgtgcgccacaacatcccggtcaccgccgtcgtgttccacaaccgccagtggggcgcggagaagaagaaccaggtcgacttctacaaccgccgcttcgtcgcgggcgaactcgacaaccagagcttcgcggcgatcgcgcgcgcgatgggcgccgaagggatcacggtcgaccgcctcgaggacgtcggccccgcgctcaagcgcgcgatcgacatgcagatgaacgaaggcaagaccacgatcatcgagatcatgtgcacgcgtgaactcggcgatccgttccgccgcgacgcgctgtcgaagccggtacgcatgctcgacaagtacaaggactacgtgtgagcccgcgtcgctgacgcaaccgcgtcaggccgcgcgcatcgccgcacggcctgaacccggccggacgccgtgccccgtgcgggccgccgcatccggccgtttttccttcccgttttccattcctcagcgagcgaacgatgaaagccctcgaccgcatcctcgaatccgcgcgcctcgcgccgatgcgcatcgcgctgtgcgaagcggacgatccgcgcgtgctgcacgccgccgcgcgcgcgacgcgcgacggcatcgcgcgcatcgtgctcgtcggcaaccgtgcggccatccacgcggcagccgcgcgcgacgcgatcgatctagacggcatgatgctcgtcgatccggccgacgccccgcaacgcgatgcgtatgccgacgcgctgcatgcgctgcgcgccaaaaaggcatgaccgccgacgcagcacgcgacgcggtgcgcgatccgttgacgtacgccaacctgatggtgcggctcggcgacgcggacggctcggtcgcgggcgccgtgcacgcgacggccgacgtcgtgcgcgcggcgatccagctgatcggcgtggacccggcgttccggatcgtgtcgagcttcttcctgatgatgctgtgcgaaccgttccacacgatcaagggcgggctgatcttctccgactgcgcgctcgtcgtcgatccggatgccggccagctcgccgaaatcgcgatggccgccgccgacagcgcacaagcgctgctcggcgaggaaccgcgcgtcgcgatgctgtcgttctcgacgagcggcagcgcgcatcacgcggccgtcgacaaggtgacggccgcgaccgcgcaggtgcgcgaactgcgccccctcgcgatcgacggcgacgtgcagctcgacgcggcgatcgtcgcggagatcgccgagcgcaagatcgcgcattcgcaggtgggcggccatgcgaacgtgctcgtgttcccgagtctcgaggccggcaacatcggctacaagctcgccgaacggatcggccgcgcgaaggccgtcggcccgctgctgcaggctgcgccggcccgcgaacgacctgtcgcgcggctgcagcgccgacgacgtgtatcacgtgatcgcggcaaccaccgtgcaggcgcaggcggccgcgcaacgcgccgcgaccggcgaggccgcgcacgcatgacggccgacaaactggcgatcctgatcgcggtgatcggcgccggcagctatttccagaccgtcaccggcttcgggctcgggatgatcgtgatgggcgcgacgagcggcttcgggctggcgccgctcgccaccgtcgccacgctgatgagcgtcgtgtcgctcgcgaacggcgcggccgcgctgcccggccggctgcatcacatcgactggcgcgcggtcggcgcggcgacgctcggcatcctgccgtcggtggtcgcgggcgtgctgctgctcgaatgcctgagccgctcggcagccgacctgctgcaactgatcctcggcgcggtcgtgctgtacggcggcctgagcgcggcgcggcgcccgacgccgctcacggcgcgctcggacaaccgcagcttcttcgtcagcggcctgttcggcgggctgctgagcggcatgttcggcgtgtcggggccgccgctgatcttccagttttaccgccagccgttgacgctcgtgcagatccgctgcgcgctgatcgtgctgttcacgacgacctcggccacgcgtgtgctgtacagcgcttgcgaaggccagatcgatcgcgacatctggctgctggccgcgatcgcgacgccggtcgtgatgctgacgacggtcgccgcgcgccactatccgccgccgctgtcgccggtcgcgctgcgccggctcgcgttcggcgtgctgatggcgatcggcatcgggctgatcgcgacgtcgctgccgccgctgctgcgcggcgtgtagtgccgcgcggcgcatgccgcatcgaaccctccggcgcgcggcattcgcgccgcgatgcgcacgcacactactcgcttcaccgccgcgcaccgatccagcgcgcgatttcgacgagccgcttcatgtccggcgccgacgcaagatcgatcgcgagccggtgccggtagtacgggccgagatcgagcccgacgccgagcccgaggacgtcgacgcggccggccgcttcctggcgcgcgaccacctgcttcaggtgattgtcgaggtagaacggatcgttcgcgagcgccgtcgcgccgtccatcgggctgccgtccgagatcacgacgaggatcttgcgcgcttccggccgcgccgcgagccgtgcacatgcccattcgaccgcttcgccgtcgacgccctcgcggaacaggtcggccttgaacagcgcggcgatgcccgtgcgcgcatgccgccagcgcgtgtccgcgtccttgaacaccaggtggccggtttcgttgagccggcccggatggcgcggcttgccgcgcgcgagccagtcctgccgcgcgcggccgccattccacgcgagcgtcgtgaagccgagcacttcggtcgcgaggccggcggcatcgccggcgcgggccagcgtgtcgaccatcagcgcgacgccgtcgatccacgtcttcatcgatcccgagcagtcgatcaggaacgcgagcgcgcagtccgcgtgcggccgcacgcgttcgagccggaacaacctccgttcggccggcgagctgacgagctgcgcgagccgacggccgtcgagtcggccgtgctcctcgccgaacgaccagccgtcggcctgcggcacgacgagcgccgcgcgcagcacccgtgcgagccgcgtgacgttgatccgctgcgcggcgacctggccgtcgagccggtcgcgatactcgcgcagcagtgccgcgcggatctgcgcggccggccggagttcgcggtcgtaacgcgtcgtgtacgcgcgatagacggcatcgccgccatgcagcacgacgctgtcgcccgtttcgacgagcgccggcaggtcgatgcccgtgtcgtcgaaatcgacccatagcgaaaattcgtcagcgcatcgtcctgctcgcgtgcgtcttccgatgccgtttcgacgacggccgcgcgcgcgtcgcggatcatcgccgcaatccggcgcgcgagcgtcagcgcatgttccgcgaatgcgcgctgatcgtgccggcagcgcttgagccccgcgagcggcacgccgatctccggcacgatcgccgcgcgcgacgcttcgatcaggtcttccgtttcttcgagcaccggccagccggtcagccgcgaccatgagatctgcgcgaccgtgtacacgaggatcccgacatgcgtatcggcctgccccgaccggtgaaacgcgcgcgaccaggtttcgaaacgatggcgcaggttctgcacgacgccgcgcatcgcgggtggcgcgagcgattcgcagcgcagttgctcgagcatttcgaacagcacgcgttcgaccggatcgtcgccggacaacgcgcgatgcaggccggcatccgaatgcaggatgcgcagcgccacgccgtcggccgcgccgcgccacgacgcgagatcgtcgtcggcggcctgcgcgcgcaggtgcggcgcgtggatcggcagcggccgcaggtcgcggcacacgcggcccgcacggtaatgcagcgccgcatcgcgagtcagcgcacgcacggtcgacgcgcccagcgcttcgcgcgccgacgcgcgacgtgcggcgtcgcgatcggcgctcaccgcccggctcccggcgcgccgccgccggcgcgcgacgcaaccgccagttcctcgccgaagcagcgctggtaatactcggcgacgacgggccgctcggcgtcgtcgcacttgttcaggaacgtgagccggaacgcgagcgccggatcgcggaaaatccggcagttctcggcccagttgatcaccgtgcgcggcgacatcagcgtcgacagatcgccggtcgcgaagccgttgcgcgtcagctccgcgaggctcaccatcgattcgagcagcgggcggccggcttcgtcggcgagttcgggcacgcgcgcacgcacgatgccgatctcctcgtcacgcagcagatagtcgagcgtggcgaccacgttccagcgatccatctgcgcatggttgagcatctgcgtgccgtgatacagcccgttcaggttgccgagcccgaccgtgttagcggtggcgaacagccggaacgacggatgcggatggatcacgcggttctggtcgagcagcgtgaacttgccgtcgcgttcgagaatccgctggatcacgaacatcacgtcgggccgccccgcatcgtattcgtcgaagatcagcgcgacgggccgctgcagcgcccacggcacgatgccttcctggaactcggtcacctgcacgtcgtcgcgcacgacgatcgcatccttgccgacgaggtcgagccggctgatgtggccgtcgaggttcacgcgcacgcacggccagttcagccgggccgcgacctgttcgatatgcgtcgacttgccggtgccgtgcatccctgcacgagcacgcggcggttgcgcgcgaagccggcgaggatcgcgagcgtgacgtccgggttgaaacggtatgcgtcgtcgatatcgggcacgtggtcgtcgcgcgcgctgaacgcgggcaccatcaggtccgaatcgaacccgaaccgttcgcggaccgacaccatgcagtccggcttgttcgtcaccccttccattgcgttgcgctcctgtcgttgcctgtctttgtcggtgtttgtcggtgtttgcgtgtcgctacccgatgcgcgggcgtcgatccttgtttacggaacgattcgttccatcgccggcaatccgtgccggcttgccgcacccgccgccccgtgcggccggcctgtcgggccgttcggtacaatggccgcagtccagtttccggaacgcctgccatgctgcccgcggatacgcccacgctgcgcgccttcgcgctgctcgaacatctcgtccaggccggcgatgccgtgtcgctcgccgatctcgtgcgcgaggtcgatatcccgaaggcgtcgctgcaccggatgctcgcgtcgctcgaagccggcggcctcgtgatccgcgagccgggccgcaagaacgcgtacgcgatcggcccgcgcctcgcccggctcggcaccggcgtgatgctgcatgcgggcgcgcgccggctgcgccatgcgatcctcgaacggctcgtcgccgatctcggcgaaacctgcaacctcaccgcgctgcacgacacggaagtcgtctatctcgaccgcgtcgaagccgactggccgctgcggctcgacctgaagcccggctcgcgcgtgcccgcgcattgcagcgccagcggcaagctgctgctcgcgctgctgccgcgcgacgagcgcgccgcgctggtgcgcgcgctggcgctgccgcgctacacgccgaatacgatctccgatcccgaactgctcgaagccgaactcgaccgcaccgcgcacaagggcgtcgcgatcgacaacgaggaattcgtcgcgggcatcgcgtgcatcgcggcaccggtcgtcggcgacgacggcgcgtgcatcgccgcggtcgccgtgcatgcgcccgtgtcgcgcgcaccgctgtcgcggctgctcgactgcgtgccgcgcctgcaggaagcggccggcgcgctcgcggcgaccttctagcgccgcgcaccggcacgcgcgcaacgtcatgacgcgcgctggtagtagatgttctgcggatgccgcgcatccgcgaagaagaaccagcgttccgcgaccagccccgcatactggatcacgaatgccgcgccgagcacgacggccgccgcgaccgacgtcggcgcgagcgcgcccgcgccggtcaggacgaacggcaccgcgaatgcgccggtcaggaagccggccttcaccgcacgcaacgtgccgttgccctgcccgtgaaaaactcccgcgtattgaacgcgctggccgtgaaaccgcgcgacttctgttcgaccttctcgtggcgaataccggtcgcgctctgcacggtcgacttcggccgcagccgggcattgcgcgcgagcgatgcaagccgtgcgacgcagcccgcgagcgtcagcacgcacgcggccgccgcgagccggccgaccagcgccggcgcgagccatgcggcgcaagccgtcgccagcgtgcagcccgacgcgcagccgagcagcacgaagttcacgagcgtcaacgggctcgcccattcctgcaggaaacgcaggcacgcgtagatcatcgcggtacacacgaacagcgcgacgctcgcgagcgcgccggccgcgccgatcagcaacgtgccgggccagccgaacaggtgggccacgccatacgcgaacgcgcacgcgagaaacaccggcagcgcaatgcattcgcgcgacagccacgacgtgcgccacatcgcgatcgcgcgccacgcgcgttcggggtggccgagatggaagaacgacgcgaacaggccgagcacgccgagcgcgaccgacagcgcggcgccggtcacgtagaacgcggcggccacgtcgacgccggccacgcgcgcgagcgcctcgacgctcacgagcgtcaacagcaaaccctgtgcggcgccgcacagcgtggtgaggaaaacgaccgaaaaggctgggcgcatggaaactccgtctggttctggatgaaaagcgcggggctcaacgctgcgtcgcgagcgacacgagatcgatgtcgccacgcgccgcgcgggcttcgaacgagtcgctctcgtcgcggctggtcgacccgctgccgcatccgccactactgccgcatgcgcacgatgcttcggtcttcacgcgcggcaagtaatggttcgacggccgcgtgccccattcgggcatcaacgcataaccaccgcggtcgcggatcgcgcgcgacacgtccgactccggatcgtgcacgtcgccgaacagccgcgccgacgtcgggcacgcgagcacgcacgccggtttccggtcgcgttcgggcagtgcgtcgttgtcgatgcggtccgcgcacagcgtgcacttcgtcatctccttgcggccttcgtcgagttcgcgcgcgccgtacgggcacgcccacgcgcagtacttgcagccgatgcacttgtcgtagtcgaccagcacgatcccgtccgacttgcgcttgtagctcgcgccggtcggacagacgggcacgcacggcggatcctcgcaatgcaggcacgacttcgggaaatggatcgtgtcggtcatcgggaacacgcccgcttcgtacgtctgcacgcggttgaagaaggtgccggacggatcgtcgtcgtacgggcgcagatcggcgagactgccggcttcgcccgacgtgttccattccttgcagctcgtcacgcaggcatggcagccgacgcacacgttcaggtcgatgacgagggccatctgggtcatggtggtgctccttcgatcaacggtcgtcaggtttcgggccggcggaagtcgcgcgccgcagccgtgcggcgaatgcgccggtgcccgcgaaatacgcgcacgcgctgcagcacgcgcggcgtgccgggcagcgccggcatcggcgcgaactgcggcagcgtggtcgcggcatccgcttcggccggatagatccgcacctgcacgtcgtaccagccggcctgcccggtgatcggatcggagttcgacatccgcgcgccgtcacgcgctgcatccggcagttcgtcggtaatgacgtggttcagcaggaaaccgcgctgcgactcgcccgcctgcggcccgaggttccacgcgccggccgccttgccgatcgcgttccacgtccacacggtgccgggctccacggcctcgctgtagcgtgcgcggcaacgcaccttgccccacggcgattcgacgtagatccacgcgccgtcgtcgatctgctgcgcggcggccgtcacggggttcacgaacagatggttctcgccgtggatctgccgcagccacgcgttctgcgaatcccacgagtggtacatcgccatcggccgctgcgtgatcgccgcgagcggatagcggcccgcgtcggtcaacccgctttcgagcgaccggtgccagaacggcagcggatcgaaataacgcgcgatgcgttcgcgcagatggtcgggcggctggcggcccgacgtgcgaccctgcgcggcgagccggaatttctgcatcacgtccgagtagagctggatcacgatcggcacgccgaacttgcgcatcccgttgtcgaccgcccactgcatgtacgggccgttgcagttgcgcatgtactgcagcggctccggcaaccggtggtggtacacgcagttgttctccgcgtaacgcttccactggtcggggttcggctcgccgacgacggccttgtcgccgtccttgccgcgccagccgatcaggaagccggtgcccgaatcgggcgcggtctggaagttgacgacgaaatccggatagtcgcggtacttgcgctgcccgtccgccgtcgtgaaggccggaaacttcagccggctcgcgagctcgatcagcacttcctggaacggcttgcactcgccggtcggcggcacgacgggcacgcgcaccgagtcgaccgggccgtcgaattcggagatcggccggtcgagcaccgacatcacgtcatgccgttcgaggtaggtggtgtcgggcaggatcaggtcggcgaacgccgtcatctccgacgcgaacgcatcgcacacgacgaggaacgggatccggtattcgccgtcgtcgcgcttgtcgaccagcatcttgcgcacttccgtcgtgttcatcgacgaattccacgccatgttggccatgaagatcagcagcgtatcgatcggataaggatcgccgcgccacgcattggtgatcaccgaatgcatgagcccgtgcaccgcgagcggatattcccaggagaacgccttgtccagccgcgcgggcgtgccgtccggatgcacgaacaggtcctcggggccggcgggccagccgagcgggccggtcgcaagcggcgtgttcggcctgacctgggcgggatcgttcggtggtttcgccgacggcggcaccgcgcgcggatacggcgccttgtgccggaagccgcccggccggtcgatcgtgccgagcagcgacatcagcaccgcgagcgcgcggatcgtctggaagccgttcgaatgggcggcgagcccgcgcatcgcatggaacgcgatcggcacgcccttcaccgtcgcgtgttccttgccccacgaatcggtccagcgcaccggcagctcgatcgcgtgctcgcgcgcgaccgtctccatctcgcgggcgaggcggcggatcgtgtcggccgcgatgccggtgatgtcggccgcccactcgggcgtgcaaccggccacctgttcgcgcagcagcgtgaacgacggcgcgacgggcgtgccgtcgtcgagcgtgtagcggccgtcgagcgccggttcggcgccttccgtgtgatgcagcaccgcgcggttcgtcttcgtgtcccaccacatccggttctgcggatacagcgcgttgacttccggcgcgccggcgtcacgcacgaacaggccgaacgtgtcggcgccgtcgcgctggtcgaccagctcggccgcgttcgtgaagcgcgacacgaattcgaggtcgaacgcgtcgcgcgcgatcagctcatgcatcagcgccatgaacagcgcgccgtcggtgccggggcgaatcggaatccattcgtcggcgatcgccgcgtagccggtgcgcaccggattgatcgcgatgaagcggccgcccgcgcgcttgaacttgccgagcgcgatcttcagcggattcgaatggtggtcttccgcggtgccgatcatgaagaacagcttcgcgtggtcgagatcgggtccgccgaattcccagaacgagccgccgatcgtgtagatcatcccggccgccatgttcgccgaacagaacccaccatgcgccgcatagttcggcgtaccgaactgtttcgcgaacaggccggtgagcgcctgcatctggtcgcggccggtgaacagcgcgaaccgcttcggatcggtcgcgcgcaggtgcgcgaggcgcttttcgagcacgtcgaacgcgacgtcccacgacaccggctcgaactgcgcgtcgccgcgctcggcgcccggcttgcgcatcagcggctgcgtgagccgcgcgggcgaatactgcttcatgatcccggacgaacctttcgcgcagatgacgccctggttcagcggatgctccggattgccgtcgatgtaacgcacctcgccgtcgcgcaggtgcacgcggatgccgcagcggcacgcgcacatgtagcacgtcgtcgtcttgatatcggcctgctcgtcgcgctcgcgtgcccgatgttccatcgtctgtcctcgttcgcggatgagggcgcccccgcggggcacgcccgtgaatcgattcgtccatgctagtcgcgccagccgccgacataaagtcgcatcctccgatcggttctatcgcgcggcccgatagttggccgcgcgatccatcaggccgccgccggcgccgcatgcgcaaagacccggcttgcgtgccgggccttcagcgtcatgcgttaccgtgcattaccgcggcggatacgcgagcagttcgctgtcgtcgagatgctcgcggcggctgcggcgcgtgagtccgtaagcgacgaccagcacggcgaggcttgcgacgccgagccacagcggcttgcgctggtccgggatgaacgccatcgcgacgaggatgccgaccatgccgacgatcgcgacccaggtgaggtacggatacgcccacatcctgacgcgcagcttgctcgcggccaccgggtcgagacgcttgcgcaggcgcagttgcgagaacgcgatcagcacgtacacgaacagcgcgacggtgccgtacgaattgacgaggaacgcgaacacggtatcgggcgacacgtacgacatcacgaccgacacgtagccgaacaccgtgccgagcaggatcgcgcgcaccggcacgccgcgcttgttgaccttcgcgagtgcggccggcgcatcgccgtggcgggtcagtgcaaacagcatccgcgacgcagcatagaggcccgagttgagcgcggacagcacggccgtcagcacgatcgcgttcatcacgttggcggcggccggcaggcccatcacttcgagtgcgctgacgtacggcgtggccatctgatgcgaattccacggcaccagcgcgacgacgagcgcgaccgagccgacgtagaacaccagcacgcgggtgatcaccgaattggtggccttcgcgacggctttcgcgggctccttggcctcggccgccgcgatcgtgacgatctcggcgccgaagtagaagccggtcgccgcgaccgccccgctcatcaccggcccgatgccgagcggcatgaaaccgccgtggccgagcagcgtcggcagcacggaagtcgtgtgcatcgacgcgggccacaggccgagcacgtagaggccgccgaggaacaggaacacgatgatcgcgccgaccttgatcgacgagaaccagaactcgaactcgccgtagctgccgaccgaaatcaggttcgtgagcgtcagcacgaccagcagcgcgaggctgatgagccacgccggtgtgtcaggcagccagaactggatcagcttggcgccggcgaccgcttcgagcgcgacgacgatcacccagaaataccagtacatccagccggtgaggaaacccgccatcttgccgggcccgcgccagttgccgaacgcgagccgtgcgtattcgtagaacgagccgacggccggcatcgcgcacgccatctcgccgagcatccgcatcacgagcacgaccagcccgcccgtgatcaggaacgacaggatcgcggccggcccggtctgctgaatcaccacgccgctgccgacgaacagcccggcaccgatcacgccgccaagcgcgatcatcgtcatgtggcgctgcttgagcccacacttcaggtcactctggttcatcgagggttgcatgtcttctccatatccagttgtccggacgccgcccgcaccaccgtcgggtgaacgcgggcgccgccggcgacggcgcgtacagggcgcctgcagccccggccgcacggatttccgctgcttttcttgtgttggacggcccggcgcgcgttgcatcacgccgggcgatgtgcactgcgttcagggctttttcagggcttttcgtcgttcctgaagtacgacaggtagagcatccgctgcccgatgcgccggaacggcgcgaacgggtggccgggcagcggcgacgtgaagatcggcagcgtctggcgtgcgcccttccccgcgatctgttcggcgagccggcggccggcctgctgcgaatacgacacgccgttgccgccgtagccgagcgcgtagtacaccgactggcgcgggtcgggctggcacacgcgcggcatcatgtcgtggctcacgtcgacccagccccaccacgaataatcgatctgcacgccgcgcagcgcgaaacttgcgcgccatcccttccttcagcaattcgacatggcgcgggttcggcgcatcgtcgccggtgatcgcgctgcggctgccgatctgcagacggcgatcgggcaggaaacggtagtagaagcgcagcgtacgcgtatcggtcagcacctgcgtcgtgcggaaattgcacgcgtcgatttccgcgtcggtgagcgggcgcgtgaccatcgaattcgacaggatcggcatcaccttgctgcgcagcgacggatgcagcgtctgcgccgtgtacgcgccggtcgcgatgccgaccgcgcgggcacgcacgacgccgccgggcgtgcgcaggtggtgcacgccgtcgatcgtctcgaagccgagcaccgggctgctcgtatgcaccttcgcgccggctgcgcgcgcgaggcgcaggtagccgaacgcgagcttcagcgcatggatgccgatgccttccggctcgtgcagcgcgccggccgcctcgtggtcgttgatgaattcacggcggaaggtttccgcgctcagcagttcggacgggtagccgaacacgtccttccacaccttcgcctcggccgcgagcttcgccatgatgcgcggacggtgcgcgatcaggaaatggccgcccggctgcggatcgcagtcgatttccgacaccaacgacttgaagtgttcgaagccttcgaggatctcgtcgtgcatcttcagcgcgacgtccttgccccagcgctcgatccactgcgagcgcgacagccggcccgatgcgttctgcccctgcccgccgttgcggctgctgcagccccagctggtgcgattggcttcgagcacgacggccttgatgccatggtcccgcgcaaggcacagcgcggtcgcgaggcccgtgtaaccggcgccgatgatcgcgacgtcgacgtcgagatcgcgcgtgacggggccgtcgtcgggcggcgggctgccggccgtcgcgacccagtaggtcggcgcgtactgcttgccgcaacctggccccggcgacacgagcggatcgtaggtcgggtcgtaacgcgtatcgttcgaccggccgccggcaaaaccgctcgcggtgcgttcgatggaaggggtcgacatggtcagacctccgatgcgggcttgcctgccgcgccgcaacgggcgcgcgaggcgattcgactgactgatgcggggcatacgctcgccgggggcgaatgctgccgactgcctgttggtcatgcctgtctcctgatcgttctcttcgggtcgatcgtgtgcagatgcttcaatgcggcgatctgtcgaggaaagtgtaggcaggccgtttttggcaggtagggccagtgggccggattcgcttggaccagcgtgcgagggtgccgaacggcgggaatggcaggcgaccgcgggcgggcggcggcagtcgcggcgcgggctcgccccacacaatcgggagcccgaacggcgggcagcagcggacgagcggttggcggtaacgatcagctgcgcgggcgccgccgactgatgatcgacgaccgccaaccgccccgtcgaaacggccccgcgccccgcccgctccatccgccccgcccgccgtcacatcgcgcgcaccgcgacctcggccacgctgccgcgcttctcgatcgcccgcgcggacacgatcgacaggagtgcagacaacatcacgtacaccccgacgagccacggcgcaccgccgttcacgcgcagcaacgcggtcgcgacgatcggcgtcaggccgctcgcgaagatgcccgacacctggtagacgaacgaaatgcccgtgtaccgcacgttcgcgtcgaacagctccgcgaacagcgcggcctccggcccgtacgccatcgcgtagaagatcccgaacgggatcaccagcgcgagccatacggcgagcaggttcgacgactgcgtctgcagcagccagaacgcgggcagcaccgacagcccgcacagcgtcgcgccccaccggtacacccgtgcgcggccgagccggtcggacaggctgccgaacacggggatgaacccgcacatcacgaccgccgcgctcatcacgccgagcagcgcgtcgccgcgcgagatcgacaggttgcgcgtcatgtagccgatcgagaacaccgcgaacacgttgaagaacacgccgtcgatatagcgcgcgcccatcccgagcaggatcgcctgccggtagttggcgagcagttcgaccaccggcagcttcgtatcgcgccgctggcgcttgagcgcgacgaattcgggcgtatcggccacccgcgtgcggatgtagaagccgaccgcgacgagcagcagcgacgccgcgaacgccacgcgccagccccatgcgaggaacgcggcgtccggcaacacgcgcgacagcgccgcgaccacgccggccgcgaggcacagcccgatcgcgagcccgatctgcggcaggctcgcgtacagcccgcgccggtgcggcggcgcatattcgtacgccatcagcaccgcgccgccccactcgccgccgaggccgatgccctgcagcacgcgcagcgtcagcagcagcaccggcgcccacatgccgatctgcgcgtaggtcggcaggaacgcgacgccggccgtcgacacgcccatgatcagcatcgtcaggatcagcgcggacttgcgcccgacgcggtcgccgagatggccaaacagcaagccgccgagcggccgcgtgacgaagccgaccgcgaacgtcgcatacgcgagcatcgtcgacacgaacgggtcgcccgccggaaagtactgcttgtcgaacacgatgccggcgacgacgccgtacaggaaaaagtcgtaccactcgacggtcgcgccgatcacgctggccgcggccacgcgtcggacgacccgggattcgattgccatgcgagcttctccaggtaaggatgcgccgcaacctgccccggcgccgtaccggcgggggcatcgatgaacgcgcggcggccgtccgggcgcaggcgcacgggccacgcggggagatgcgtggcgaggccctacgcgacggcctcggcggccggcgcgacgctgcggccgcgatcggcggcgtacgcgtcgtcgaggatcatgtcggacgccttctcggcgaccatcacgatcggcacgttggtattgcccgatacgagggtcggcatgatcgagcagtcgaccacgcgcagcccgcgcgtgccgtacacgcgcagccgctcgtcgacgaccgcgagcggatcgctcgcgacgcccattttcgccgtaccggacggatgaaagatcgtctgcccgtattcccggcagaactcgagcagctcgtcgtccgtctgcgcgtccgcgcccggccgcacctcgcgcttcatcagcggcgccatcggctcggcggccgcgacgcgtcgcgcgaagcgcacgccggccaccgtcgtgcggcggtcgcgctcggtgtcgagatagttcggctggatcgacggcgcgtcgcgcgcgtcgtcggtgcggattcgcacggtgccgcgcgattcgggccgcagctggcagatcgaatacgtgcagccgggaaacggatgcacgctgccgcccgccgaatccgccgacagcgtcgagaaatggaactggatgtcgggcgtcgccgattcgtccggcagcgcacggcagaacatcccgccctggttgatgccgatcgcgagcgggccgccgcggaacagcgcccattgcagccccatcttcgcgcggccgacccacgaatgcagttcgtcgttggtcgtgatcggcttcgtcacttcatagatcagacgaatctgcagatgatcctgcaggttctcgccgacgcccgcccgatcggcgacgaccggaatcccgtgccgcccaagcagcgcggccggcccgacgcccgacacctgcagcagttgcggcgactgcagcgcgccggccgcgaggatcacctcgcgcagcgcacgcacgtcgtgaaccttgccgtgctgcacgtaccgaacgccggacgcctgcgtgccgtcgaacagcaccttcagcgcctgcgcatcggtttcgacatgcaggttcggccgcccgcgcgcgggcttcaggtaggccaccgccgtcgagcagcgcagcccgttgcgcgtggtgagctggtagtagcccacgccctcctggtcgcccgtgttgaaatcgtcgacggtgcgcacgccgagccggttcgacgcggcgacgaacgcatcgacgagttcgtgccgctgccggatcgcggaagcccacagcgggccgccggtgccgcgcgtcggcccttcgccgagcgtgttgtgttcgagcttgcggaaatacggcaggcactcgcgccagctccagccgcgattgccgagcgcggcccagtgatcgtagtcctgctgctgcccgcgcacgtagatcagcccgttgatcgagctgcagccgccgagcgtgcggccgcgcggccagtacaggcggcggttgtgcatgttcggatcgggatcggtgtggaagccccagttgtacacggggtggaacatcgtcttgccgtagccgatcggcacgtggatccacatatagctgtcggcggggccggcttccagcaggcacaccgtatggcggccgccgtcggacagccggttggcgaggacgcaaccggccgatcccgcgccgaccacgacatagtcgaagctgcgtgtcattccgtgtctccgttccggggttttgaaaaatccggtatgtttcgtccaaatttattgagcacacggaacacgtacaagccgatttattgtccacgcggcgaatgtggtacaaaaaccgttcaattcgtttcatttccatcgcacacacaccatcccgggacgcacgccgatcccgacggaggagacacatgcgcgaacctgcccccgcgctgcccgacggcgcgcccgccgacgacgcgcgcgtgctgcgcgccctcgccgtgctcgaagcgctcgcgtcggccggtcagccgtacacgctgtcgcagctcgccgcgcggctgcacatcccgaaggcgacgctgctgcggctgatcgagtcgctggaggcgcgcggctacgtgatccacatgcccgactcgcgcggccacgaccgcggcatcgcgctcggcccgcgcgccgcgcagttcgcgctcgcggcgctgtcgaacaacaccttcacgcgcggctgccgctcggtgctgcgcgcgctcgtcgacgtgctcggcgagacctgcaacctcaccgcgctcgacggcgacacggtgctgtacgtcgaacgcgtcgagacgaccgagccgctgcggctcgagatgcggcccggcatgcgcgtgccgctgcactgcacggcgagcggcaagctgttcctgtcgcagatgaatgcgctggagcgcaacgcgatgctcgcgcggctcacgctgaagaagatgacctaccggacgctgaccgatgcgcaactgctcgcggccgagctcgaccggctcgccgcgcgcggcgtcggcatcgacaacgaggaattcgtgcgcgggatggtggccgtcgcggtgccggtgaaggatgccgcgagcggccgcttgcttgcggcgctcgccgtgcatgcgccgaccgcgcgcgcgacgctcaacgatctgctggagaacgtgccgaaaatgcgcgacgcggcgacgcggctcgccccgctgctgcaggcggccgatggcgcaccggcgggttgaagcggctgtgcgcggtcactcggtcactcggtcaagcgttcaagcgttcaagcgttcaagcgttcaagcgttcaagcgaggtgataacgcagccagaaggtttcgcggcacgcgttgtcgaacgtcatccgcgtcgggccgatcggctgcgcatcgggatggcgaagcacgtcgtagtcgatccagcactcggcgcacagcaggtcggacggcgcgcggtcctgctcgaccgagcggcgcacgatcgcgccgttgtcaaagcggtattcggtttcgtcgcgcgtgacctcgacgtcgtcgtcggtccagcggtcgtgcgacgtgacatgcgacacgatcgacaccgggcccgcgagcccgtggatcgcggcgacgtaggaaatgagcttgtccatggcgaggcggcgaacggtgggatggccgcctcgcgcaacatggatggcacgaggcggctcgagcggcgagtatagccgcgcatcgatgaccttgccgcccgtggggtttcgcgcgctacgcctccagcgcgagcaacgcgaacgtcgcgagccagtgctctcccatgtagtcgccggccacgtgcgcgagcgcgctcgcgaggtgccggccggccgcatcgagcagcttcgcgcgccgcgcgtcgccttccggcagcgcgccggcgagcgcgcgctggcaccacgcgcggctcaggttcagcccgtcgagatgggcgatcttgccgtcgctgcgatcgctgaccgtcgccggctcgaacagcgtcgccggctcgccgcgcgcgagatcgggcaggaagcgcgcgaaccagccgtcgaattcggcggccggcagcacgcgccgcatcagctcggcctccatcagcgcgggcgacaggaattcgtcgcccgacggctcccacgcctggcacgcgacgtcgttcaggtgccagcgcttcgcggtatcgacgatcagcgccgcgagcccgtcgcgctgcgtgtcgcgcgcgaagtcgagcgtgagcgccagcgcgaacgcggtgttgaagtgcgtgccgacgcgcagcggataggtcgctttcggcaggaaggtctcgaagcgcgacacgaacaggtcggtgagcggtgccatcgtcttcgcccagcgcgcggcctgcggcagcgccccctcagcgcgagccgctcgagctgcgcggcgagcgcgagcagccacgcccagccgtaaggccgctcgaagccgctgttgtgcggcagcgcgaggtacgcccgctcgccggcgacgttcgcatcggtgaagtgcgcatcgacgatcgcgacgatgcgttcggcctccggcaatgccgggtagcgttcgagcacgcgcagcacgagccagtagccgtgcacgcacgagtgccagtcgtagctgccgtagaagatcgggtgcagcgcgcgcggcccttgcacgtcttgcgggccggcgagcgaatgcgtgagcttgttcggatattcgcgggtcaggtgcgcgagcgcgagcgacgcgaacttcgacgcgagttcggggtgagtcggtcggtcatgaggatctcgtccatcgagtcagaagcggaatacgaacgcatacatcagcagcgtgttcacggcgagcagcagcacggcggtcggccactgcgccttgatcacgccgttcttgtccttcagttcgagcagcgccgccggcacgatgttgaagttcgcggccatcggcgtcatcagcgtaccgcagaagccgctcagcatcccgatcgcgccgacgatcgccgggttgccgtggaactggtggacgatcagcggcaggccgatgccggccgtcatcacggggaacgcggcgaagccgttgcccatgatcatcgtgaacagcgccatgccgaccgtataggccgcgaccaccgcgaacggcgaatcgatcggcacccactccttcacgagccccgacaccaccccgccgacacccgcgaccgcgaacagcgcgccgagcgccgcgagcatctgcggcaggatcgcggcccagccgaccgcatccatcgtatggcgtgcctcctctcaccgcatgcaccggcgaatcgcgcagcatcgcgagtgcgacggcgaacgcgacgagcgtgccgagcacgagcgagatcagcgtcacgctcttctggtcgacgaacggcacgcccttcagcgcgaacgtcccgatcagcgtgacgaccggaatcagcagcgcgggcaggaacagccggttgccgaaacgctgcgcgagcgtctcgcggcgcacggccgcggtttccccggcttcgtcggacttgccgcgcccgagcttgcccgagccggcgagcaccgcgagcgcgatcgcgaggcagcccgtcacgaagtgcggcagcagcgcgccgaacaggaacgtgaccgcgtagatcgcccagaacgcgaaattgacgatgcggcgcgggttcgtgcggtccgtcaggttgaagcacgcgaacgcggcgaacatcagccccgcgagcgtgtacagcgattcgaggccgatcatcgcgcgccctcccgcccgaccaggccgaagccgcgcgtaagccggcggtcgagcagcgcgaggcgcgtgcagtggatcagcagcgcggcgatcgcggtcgggatcgcccacaccgacaggtgcagcggttcgatggaaatcccgttctgttcgagaaagcccttgatcagcaggatcgactggatcgcgatgaagatgtcctcgccgaagaacacggcgacgttgtcgacgcccgacgcatgcgcgcggatctgctggcgcaccgcttcgggcagctcgccgtgccggttgaccgcggcggcctcggccatcggcgcgatcagcggccgcaccatctgcgcatggccgccgagcgacgtgaggccgagcgcggccgtcgcctggcgcagcacgaagtacagcatcagcacgcggccggtggtggccgcctgcacacgcgagatcatccgcttcgcctgttccttgagcccgttgcgctcgagcagcgcgatcaccggcagcgtcagccagatgagccccatgtagcggttttcggtgaacgccttgccgaacgcgctgacgatgtcgacgagattcagcccgcccgccagccccgtcgcgagccccgcgatcgtgaccaccagcagcgcattgaagcgcagcgcaaaaccgatcacgacgatcggcaccccaatcagcaccagcattgctcctccttgtatcggacgcgcggcgccttggcatcgcgccgcctgcccggtttggaccgggctctgacggcgcaatctagcacgagactttatcgataaaaagtcgacaatttgctgcttcgggtaaacgttgaagtgtgcggacaccgtgcccgaaccatgtgtcggcgacgtttcatccgaggaatcggtggctggccggccggcgcggacgcaccggtcgcggcacgcgcgttgccgccccggagggcagcgtgcgacgggccgccgcgcgtggcggagcaccggtgcgccgactaaactggaaagcatcggcaacggacgggagagccgccatgattgacgtattccagaccatcggcagccgcgcgttctccgctcatctggcgaaggacgggatggtgacgctgatggagcaacgccatgaggtcgatcgcgtgacgctcgcgaccgcgtatgccgcgctcgtcgaggaagccgagcaggaagacgacctgctcgacgcgacggtcgaaggcatgatgcgcgcgctgatccagggtacgcgcgcagccattgacggcgcggccggtttcctccggcgcccgtcgaagcgaaaaacgagcctgcgcgggcgctacgcggccggcgtgccggcgcccatgtcgaaccaccggcccgcgcgcagttgccggtagtcggcctgcgtgaagatcctcagcaggttcgcgactgcgccgttgctggcgcggtcgagcgccgtcatgaaggcttcgacttcgtcgcggccggcaaacaggatcgtgcggaagtagcgttcgcgctccgcgtcggacaggttcgtcgcgctcagttggtatggatggtgaagcgccgcgaacaggaagtagtagcgctcggcgtcgtcgcgcagcacgcgcaccgcgtcgggatcgaccgggaaatcgcggtggaacgacgcatgtccgctctcgatgtagatccggtacagcaaccggccgtcatgctcggtgacgatcggcgcccacgggtcgcggctgacgagtacggtgtcgggcacggccatcctgaattctccccgtcttttgcttcgaagccgccacggtaacatgccggcttccgcggcctgccgtgccgaaaccgcgcggccatgcacgcgcgcgcgggccggcccggctccgccgcccgccgcaaacaccgcacagtcatagaggaaacgcactgaatcggcgcaatgcgcaaattttcgattgccgccgcccgcgccgcatgacagcattcggggcgtcgccaaccgaaagaatgccgtgccgtccggccgccgatgccgtccggcggcgccgaacaggcccctccttccatgaacccggcccacctccagcatcacgaaccgaccggagaattccgcttgtgaacatcggcatcgtcaacgacctcccgcttgccgtcgaggcgatgcgccgcgcgatcgcgcgacggcccgagcaccgcgtgctgtgggtcgcgaccgacggcgcgcaagccgtcgaactatgcgccacgcagccgcccgacgtcgtgctgatggacctgatcatgccgaaattcgacgggatcgaagcgacgcggcggatcatgcgatccgaacgaccgtgcgcgatcctgatcgtgacgagctgcatcggcgcgaatgcgtggcgcgtgttcgaggcgatgggcgccggcgcgctcgacgcggtcgatacgccgcggctcggcgacggctcggccggcgacacgacccggctgctgctcgcgaagatcgaccagatcggccgcctgctcgacgcgcccggcggctcgcgcctcgccggcacgcccccgcgcaccggcggcggaccgctgatcgcgatcggcgcatcggccggcggccccggcgcgctcgcgtcggtcctcggcggcctgccggccgatttcaacgcaccgatcgtgatcgtgcagcacgtcgaccgcgcgttcgccgaaggcatggcgcaatggctcgacggccagacgtcgctcgccgtgcgcgtcgcgcgcgaaggcgaccgcccgcagccgggcgtcgcgctgctcgccgcgaccgacgaccacctgcgcatcacgcgcgccggcacgctcgaatacacgcgcgagccggccgccacgccgtatcgcccgtcggtcgacgtattcttcaacagcctgaccgagcactggcccggccgcgtgatcggcgtgctgctcacggggatgggccgcgacggcgcgatcggcctgaaggcgctgcggatgaagggctaccatacgatcgcgcaggacgaggcgacgagcgccgtctacggcatgccgaaggcggccgcgacgctcggcgcggcgcgcgcgatcctgccgctcggacgcatcgcgggcgagctggcggcgctcgcacggatctgaagcccgatgaacacttgcaacacccatgcctgccctcgcaacaacccgcatcgaccatgagcattgacccgactcacccgccaggcggccctacgtgccgcccgccgacgtgccggcgatggtgctgctggtcgacgaccagacgatcgtcgcggaagccgtgcggcgcgcgctcgtcgacgaggaaggcatcgatttccactattgcccgcgttcggacgacgcgatggccaccgcgatcgagacgcggccgaccgtgatcctgcaggacctcgtgatgcccggcaccgacggtctgagcctcgtgaaggcgtaccggacgaatccggcgacgcgcgacgtgccgatcatcgtgctgtcgacgcaggaagagcccgtgatcaagagcgccgccttcgcggccggcgcgaacgactacctcgtgaagctgcccgaccgcatcgagctcgtcgcgcgcgtgcgctatcactcgcgctcgtacatgaacctgctgcagcgcgatgaggcctatcgcgcgctgcgacaatcgcagcagcagttgctcgaagccaatctcgagctgcggcgcctcacgcattcggacggcctcaccgggctgtcgaaccggcgctatctcgacgaatacctcgccgccgaatggcggcgcggcacgcgcgagcgcagcgagctgtcgctgctgatgatcgacgtcgacaatttcaagctgtacaacgacacgtacggccacgtgtcgggcgacagcgtactcaagcagatcgcgtcgaccatcgagcgctgtctcggccagtcggggatctcgccgcgcgtttcggcggcgaggaattcgcggtcgtgatgccggccacgtcgccgggtgccgcgcggctgctcggcgagaagatccgcctcgcggtcgaagcgctgcggctccagcatgcgcattcgtcgacgggcgacaccgtgacgatcagcatcggcggcgcgaccatcgtgccgacgccgggcctgccgacgaccgtgctgatcgaagcggccgaccgcgcgctctatcgcgcgaagcacgagggcaagaaccgcgtcgagatcgacgcgacgccgacaccgcccgtccccggcggcttcggtgcgccacgcgccgactgaacaccgaacgccggctcggcgcctcgctcacgcggcgccgagccggcgcgcgtagtcgctcgggtccagcgggcggctgaacaggtagccctgctgcatgtcgcagccgatctgctgcaggaaccacgactgcgcctgcgtctcgaccccttcggccgtgaccttcatcccgagcgaatgcgccatcgcgacgacggcctgcgtgatcgccaccgaatcgtgatgatcgggcacgcccgacacgaacgagcggtcgaccttcaggttgtgcagcggaaagcgcttcaggtacgcgagcgacgaatagccggtgccgaaatcgtcgaccgagatgcgcacgttcatgtccgtgagcgcctcgagcatcggcagcacggtgtccgtgtcgttcatcagcagtccttctgtaatctcgagctcgagcgcggacggatcgagccgcgtctgcgcgaggcagcgaccgaccgactcgacgaggccttcgtggaactgccgcggcgacaggttgacggccagcaccaggtcgggcgcgatcgtgcggcgccattcggccgcctgccgacacgcggtttcgagcacccactggccgatcgcgacgatctgccccgtatcttccgcaaccggaatgaactccgccggcgacatcggcccgagctcggggctcgtccagcgcagcagtgcctcggcgccgacggtgcggccgctgcgcgcgtcgacgacgggctgatacgcgagccgcagcatgtccgacgcgagcgcgcgccgcagcgactgctcgatcgcgaagcggcgctgcaaccgcaggttgagctgcgcggtgaagaacgtgaagtggttgcggccgcgctgcttcgcgtcgtacatcgccgaatccgcgttgcgcatcagcgtgacggcatcgtcgccgtcgcgcggcgcgacgctgatcccgatcgacacgccgagccagtattcgttgttcgcgatcgcgaacggcttcgcgatcgcgtcgatcacctcgcgcgcgagcaccgcgagcttgtcgggatcgtcgcagtcgtcgacgaggatcacgaactcgtcgccgccgacgcgcgtgagcgcatgctgcccgcctccgcacgccgcgagccgtgccgcgacgctgcgcagcagcgcgtcgcccgcgtcgtggccggccgtgtcgttgaccttcttgaagccgacgagatcgatgaacaggatcgcgacgcgcgcgggcccgcccgccgcatcgtggccgccgaacagctcgcgcatgcggtcgccgagccagcggcggttgtagaggcccgtcagcgcatcgcgcgtcgccaggtagcgcagcgctgctgcgcttcgcgcacggggccgatgtcgttgaatgaaacgagcaccgagtcggcctgcgtttcgccgggcctcacgatcggcaccgcgttgccgcgcacccagatggtgtcgccgtccgccaggccgaaaccgaccgtgtagtcgagcatcggcgtggccgtttcgagcgcgcgccggctcggccagtcgtcgggcgcgatcggcgtgccgtcctcgcgcagcttgcgcaggatcaccgtcgacagcctgcggccgacgaggtcgcccttcacgcgcatcatccggttcgcactcgggttgctcgcgaccacgacgccatcgcgcgacacaacgaggatcccttcgttcaggctgttcaccacgagccggtgatgttcctcgctgcgcgcgagctgtcgcgcgatccggtcctggtgcaccgcgaggccgacgctgttgccgatgtcgcgcagcagttcggtttcctcgtcgctcggccggcgcggcatgcggtgatagacggcgaacgcgcccagcacggcgcccgcgtcgtcgaggaacggcaccgaccagcacgcgcgcaggcccagcggcagcgcaaccgcacgatagtcggcccaggggatcggtttcgatgtcttcgacgacgaccatccggcgcaggtacatcgccgtgccgcacgagccggccaccggcccgatcgtcgcgccttcgatcgccgcgctgtactgtcggggcagcgacggcgcggcgccgacgtgcacgtgcacgccgtcgatatcgagcagcaggatcgtgcacgacgcaccgtcgccgagcaaagcctcggcgcgccggcagacttcgacgagcagctccggcagcggtgtgttgcgcgtgatcagcctcagcacgctttgctcggacgcgagcacttccgccgcgagcccgagactgtaacgagaactttgcggttcggtattcaagatgaatcctgccgtctgtccgatcgggtctgatgcgcccgattcgttttcgatccttcgtgccgtttttcgctccgggtatacgccgatgcccggtgcgccccgtattgcacgcggtgccaacgcgcgccgaaatacatttaacaccaatccgtggcaacccgggcgtccatgcgcatcaggggttacacgcggtcgatgcggcatgtccggccggcagtcggtccgccggaagacctgcgcgcggcgcgaccgctcccggcaaggccgtgcgccatgcgggccgcgctcgaaagccattcgtcagattgcggcgacgccccggctccgttcgcgttcgatcgtccgcgccgggatccgtgcgcgtgatcgccttcgatgcgttggtggcggccgtgaccgccacgctccgggcgccgcgcccggcgccgatgcatcgggcatcgggcccgcacgcgccggccaggcttgcagcgcggcaccggtgcgagcgtcaatccttccggatgtgttcggccaggaaatcgatcagcagccgcacgcgcggcagcagcccgcgccgcgacggaaacaccgcgtgcaccacgccgcccttcggcgcccagccgggcagcacgtcgaccagcgtgccgtcgcgcagatcgtcctcgacgaccatgcacggcagctgcacgatgccgacgccgtgaatcgccgcatcgcgcaacgcgtgcatgtcgtccgtgacgaagcgcggatgatggcgcagcgcgcgtgctcgccgttcggcccgaccagttgccacacgtgatgccgcgccggccccagtcgagactcggcgcgccggccagcccggccgggtccgacagcggcgcgcgcccgtccagccagtgcggcgcggccaccagccgctgcgggctgtcggcgagcacgcgcatcacgagatcgctgtcctccagcggcgggaagcgcacccgcagcgcgaggtcgaacccttcgctcagcaggtcgacgcggcggttcgtcgcctcgagatgcacctgcacctgcggatgaatcgccatgaagcgcgcgaccagttcgctcacgcgatattcgagcagcgcggtcgggcaactgacgcggacgatgccgcgcggctccgcgtgccggcgctcgatcacctcgcgcgcggcgtcggcctcgaccagcaccgcgaggcagcgctcatggaattcgcgtccggtttccgtgacggtgaaatgacgcgtcgtccgctgcagcagccgcacgtcgtacttcgcttccagcgcggcgatgcgccggctcagtgtcgatttcggcacatccagcgcgcgcccggcctgcgtgaacccgccgtgttcgaccaccttcacgaaatagtagaggtcgttcaggtcatccatgattgttccactcatagaacactgacggcattttaagggactggaacgccggttgttgcacgcctagcatcctgtttcagcgtggatcgagcgtgtcgcggcagccgggaattttctcgaccggctccttcgcccgacccgacggttcactagacttggatttaccccctcacttcccgcatcgtcactggaggcaaccatggcaagcgaaccggttcgcgaccccgcgaacgaccacctgctcaccccgcagaacgcggcgttcatcgtcatcgattaccagccggtccaggtgaactccatcgcgtcgatggatcgccagctgctgatcaacaacatcgtcggcgcgtcgaaggcggccgtcgcgtacaacctgccgatcgtccactcgaccgtgaacgtgaagacgggcctgaacaagccgccgatcccgcagctgcgcgcggcgctcgaaggttatccgacctacgaccgcaccagcatcaactcgtgggaggacgtcgaattccgcaaggccgtcgaagcgaccggccgcaagaaactgatcatgaccgcactgtggaccgaagcgtgcctgacgttcccggcgctcgacgcgctgaaggccggttacgaggtgtacgtggtcgtcgatgcggtcggcggcacgtcggtcgccgcgcacgaagccgcgctgcgccgcatcgagcaggccggcggccagatgatcagcgtcgcgcagctgttctgcgaactgcagcgcgactgggcgcgcagcgccaccgtgccggcattcatcaacctgttcatcgaaaccggcggcaccgcaggcatccagttctcttacgacaagagctgaccggcacggcacgcgcggcggccggcgtgtccggccgtcggcgcgcgccgctgccctgcttctccgttccggcgcggccggactgcatcgcggccggcaggccgcgttttcgtatccgtgattcaatgtcgatggctccggcgccgcgcatcgcgcgcggcaaggcgatgtgtaccctcatcgattgaccttcacaggatcaccatgacgaaccctgccgaaatcaaggcgctcgttttcgatgtattcggaacgatcgtcgactggagaagcggcgtcgcacgcggcgccgccgcgttcctcgatcgccatgcacccgcactcgacccgttcgaattcgccgatacgtggcgggccgaatattcgccgtcgatggaagaaattcgcagcgggcgccgccgctacgtgcggctcgacgtcctgcatcgcgagaacctcgtgcgcacgctcgaccgctacggaatcgtcgacgtgcccgacgccgacatcgacgcactcaacctcgcgtggcacagcctcgacccgtggcccgacgccgtcgcggcgctgcagcggctgaagcgacgctacatcatcgcgccgctgtcgaacggcaacatccggctgatggtcgacgtcgcgaaacgcgcggggctgccgtgggatgcgatcctcggcgcggaagtcgtgcgcgcgtacaagccgtcgccgcaggtgtacagcgataccgtcgagattctcggcatcgagccggccgagctgtgcctggtcgccgcgcacaacggcgatctcgcggccgcacgccggcaggggctgtcgaccgcgttcgtgctgcggccgaccgaacacgggcccggccagacgaccgacctgcgagccgttgatcagtgggacttcgacgtcaaggacctgaacgaactcgcggaccggctgggctgcccgggttgaaggcctccgggtcaggggcgcgagcgtggcgctggcggccacgatgcggggccggtggagcggcgcgtcaagcaggacaaacgcgccgacagacgactggtagactccgcaaaccttgtcccattgcacccgcctgccctgatgtcgtcacccctgcgtcttgtcgaaggcaaactgaccgcgatgcgctttctcgagcgccccgaccaaggtggcgccggaagccgtcaggtgccgcccgtcgaccccgaagcccgcaagaaatcgctcggctactggttcacgcacaccctggtgccgatcctcgcggcgctcaccggcaacggggccgcggccaacgccctggtgtttcagcaagccgacgaggatctcgtcctggccgagttgaacgccgcggccgacaaggtcgagcatccggcgacatggtcgtacgcgaacctgcgcgaaaccaggaccttcgcgtcggcaaacgcgttcgtgaccgtggggaagaacggcaggatcctgttcgcgaagctaccggtggaaatcgaaatcggcggcgagtcgtaccgcgggttcctcggcgggcagtgcttcgacgtcggcgacgacgtggttgccgtggtcgatcgccgtggccgcctgttcgcgctgtcgtcgccggaccggcgccgcacggtcatggatcacacgtgcagcgacacggggctggccggcctgacgcacgacatctggctggcgtggaaatggatgttcatcggcatgaactgctttgtcatcccgatcatgatcctgctgctctggaccggcgacgacggcttttccgacctgggtaccgacctggccatgctgctgggcgggccggccgcgatcggcgtcatgctcgcgctgctcctgggcgtgcggttgtcgtgggccgactggctgccggcgtggcgcacgtcgggcatcctgaaggcgctgggccgcccggatctgtgcacggtcgatttcctggctacgcgcaccgaggccgaacgcaacggccaggtgcgcgacacggatgtcgggcaaatctattacgcgcccgtgcccgtgcccaagacctagcgcaccgcctccatcgcacccgcccgcccctgcgccgcgatcgcgagacgccgccagttgcgggccgcataccggtgcgcctgccgcaacgcgagccacagcccgatctgccgaaccggcctgaagaggccacgcgcgctgaacacggtgcgccgttcgacgcgcgtcctgccgccttccaccggtgtcagcgtgaattcgtcctccagcaggccgacccagtcgcgacaccacaccgtcgacgccaccatccggtaacgcagccggcgatgctcgtcgagcacgagaatccgttggtcgatggtgccgcgatcggtcgtgcactgccgcgtgttgccgacggccggcacgccttcgagcacgcggcagctgaccggcttcggcacaccgaggcggaacagcaacggccgcgtgtcgtccatccgggcatggaggaaatgcggccagacatgctcgggccggcaatcgaacgtccactgcgaatgaatttccacgaccgtctcctggcggttgccggtgcgggcatgatgacacaaccgccccgccgcattcgtcacttcacgaccgcacgccacgcggttcgcgcgtagatgagcagcaacggcagcagcgccagcgcgaacagcaggccaagcgccagcacccacaccggccactgttcgggattccccgcacccagtagcggtacggcacgctcaggaacgcgatttccatcagcagcgcaccgagcggcacgagcgcgttcatcaccgcggccacgccgaatcgggccgcaccgtcgatgttcttccccgcaccgtacgccgcgatcaggtagacgaaatacccgatgatcgcgaccatcagcgcgccgccggccagcaggccgacactgcgcacactgcgttcatgcaactgggtagccccggccggcaacacgacatcgatcttctcgccgatctccggcacgccgccggatcggatgttgcccggcagcacgacccgctcgccatccggcatcacggcttccaggatcgacgtgtacttgatgcaccgatatcgttcggtgcgcccgctgctgtcgcgtcgctcgcaggtgtcccactcggactggtaggacacgacggtcgcctcgtatttcggcgacaccgccagtgcgtagagttcgtcgccgatccagtacgcgaacgggaaacacagcgacaccaggcaaaagcacacgagccaccagaaggcgaccgcgccgcccgccccgcgcgcgccgccggtctggcggcgcaccatgcgcgacgcgagccagtacgcggccacgccgaataccgccacacaaaccacgaacaccttgcccgcctgcgtcaacgccatctgcctttccccaataaccggccggatcttcgtcggccatttttcaattcagatcaactcgctcgtcaccgccccgcccgccattccgtcaggccggctcgccgacgaatctcagcgtccccgattcgcccgacagcagcgcgcgattcgcgtccgccgccgcgcgcaggtaatcccacagcgcggtcacgcgccgcagcttgcgcagatcctcgcggcacgtcagccagaagcaccgcgtgacgaccacgtcgtccggcagcacggccaccagcgccggctgggtggccgccatgaagcacggcaggatcgcgagcccgccgccctgcagcgccgcgaaatactgcgcgatcacgctcgtcgtgcgcagcccggccgtcgcgcccggcaccgcccggtcgaggtacagcagctcgttgctgaacgcgagatcgtcgacatagctgatgaacgcgtgctccgcgagatcgtcggtacaggtgatcggtggatggttcgcgagatagtcgcgcgtcgcgtagagccgcaactggtaatcgcacagcttcgtgaccacgtaaggcccgcgctcgggccgctcgagcgtgatcgcgaggtccgcctcgcgcttgggcaggttgacgaaatgcggcaccggcagcaggtcgaccgtcacgtgcggatgttcggcgcgaaactgcgcgagctgcggcgcgaggaaaaagcacccgaacccctcggtcgacccgatccgcacatggcccgacagcgcctcgcccgtattcgcgacctggtcgcacgcggactgcacggtcgtctccatcgcgtccgcatacgcgacgagccgctggccttcggccgtcagcgtgaagccgccggagcgcgacttgtcgaacagcagcgtgcccatcgccgcctcgagcgcgcggatgcgccgcgcgacggtcgtgtagtcgaccccagccgcttcgcggcgccgctcgcccgctgcgtgcgcgcgacttcgaggaaaaagcgcaggtcgtcccagttcaggttgccggaaaccggctcggtggcatgtcgcatcggcgagggaaaaaggggctggagtctcgggccggctgtcgatatgcataaatgcacatccaaccggtttctttatcggtacatgatgaatctgcgcataactatactcgaccgtgacctgcggaccacgagccgcggcaccaccacggagacaccatgcagacgcgatccaccctcgatgagcatgcgacagtcgcggcacctgcgcccgagcgcaccgcgaagcaccacctgctggccggctgggccagcatggccggcaccacgatcgagtggtacgacttcttcctctacggcacggccgccgcgctcgtgttcaaccgcatcttcttcccgtcgctggaccccgtcgtcggcacgctcgccgcgttcggcacgttcgcggtcggcttcatcgggcggccgatgggcggcatcgtgttcggccacttcggcgaccgcatcggccgcaagtcgatgctgatgatcacgctgctgctgatgggcgtgccgagcatgatcatcgggctgatcccgtcgtacgacagcatcggctactgggccgccgcgctgctgatcgggatgcggttcctgcaagggatggccgtcggcggcgaatggggcggcgcggtgctgatggccgtcgaacacgcgccgaagggccgcaaggggctgttcggcagcctgccgcagacgggcgtcgggctcggcctgatcctgtcgtcggtcgcgatggccgcggtggccgcgctgccggaagccgacatgctgtcgtggggctggcgtgtgccgttcctcgcgagcatcgcgctcgtcggcctcggctggttcatccgcgcgaaggtgcccgaatcgcccgacttcgagaagatgcagcgccagggcaaggccgagaagtcgccggtgacggccgcgctgcgccgccatccgcgcgaggtgctgacgatcgtcggcgcacgcgccgccgagaacacctggttctacatggtcgtcacgttcgcgctcgcctacgcgacgcagcagctgcatctgccgaaggccgagatgctgcacgcgatcacggccggcgccgcgctgtcgctcgtcacgatgccgctgtgcggccatctcagcgaccgcatcggccagcgccggatgttcgcgatcggcctcgtgctgatgtgcgcgttcgccgcgccgttcttcctgatgctcggcacgcagcagacgtcgaccgcatggtgggcgatcgtgctcggcctcggcgtcgtgttcccgattctctatgcgccggaatcgctgctgttcgcgcagcagttcccggcggagatccgctacagcggcatctcgctgtcggtgcagctggccggcgtgatcggcggcggcttcgcgccgatgatcgcgacgtcgctgctcaaggccggcggcggccagccgcattacgtgatcgcttacctcgtcggcttcggcgtgttcgcgctcgtgtgtaccgcgttgatgcggccggcgcgcgcgtaacgcaccgcccgcattcattcgatttcagttcgtcctgccgtccgccgtgcgtgcatgcgcggcggcggatacgggccgccttgtttgtcatcacctcgttccccggagagttccatgaacgccgcagttccccagaccaccctcgccctgcccaccgccaagctgctgatcgacggcgcgttcgtcgaatcgcaaagcgccgaatggggcgacatcgtcaaccccgcgacgcaggaagtgatcggccgcgtgccgtatgcgacgctcgacgaggtcgacgccgcgatcgcgtccgcgcagcgcgcgttccagacgtggaagacgacgccgatcggcgcgcgcctgcgcatcatgctgaagttccaggatctcgtgcgccgcaatctcgaacggatcgcgcacacgctgacggccgagcagggcaagacgctgcccgatgcgcagggcgacatcttccgcggcctcgaagtggtcgagcacgcgtgctcgatcggcacgctgcagcagggcgaattcgcggagaacgtggcgggcggcgtcgatacctatacgctgcgccagccgatcggcgtgtgcgcgggcatcacgccgttcaacttcccgggatgatcccgctgtggatgttcccgatggcgatcgtctgcggcaacaccttcgtgctgaagccgtcggagcaggatccgctgtcgacgatgcagctcgtcgagctcgcgatcgaggccggcgtgccgcagggcgtgctgaacgtcgtgcacggcggcaagacggtggtcgaccgcctctgcacgcacccggacatcaaggcgatctcgttcgtcggctcgacgcgcgtcggcacgcacgtgtacaacctcggcagccagcacggcaagcgcgtgcagtcgatgatgggcgcgaagaaccacgcggtcgtgctgcccgacgcgcaccgcgagcagacgatcaacgcgctcgtcggcgcgggcttcggcgcggccggccagcgctgcatggcgacgtcggtcgtcgtgctggtcggcacggcgcgcgactggctgcccgagctcgtcgagaaagcgaaggcgctgaaggtgaacgcgggccacgaaccgggtaccgatgtcggccccgtcgtgtcgaaggccgcgcatgcgcgcatcaccgcgctgatcgacgaaggcgtgaaggccggcgcgaagctcgaactcgacggccgcaacgtgaaggtgcccggttacgagcagggcaacttcgtcggcccgacgatcttctcgggtgtgacgaccgacatgtcgatctatacggaagaaatcttcgggccggtggtggtcgtgctcgaggccgacacgctcgacgacgcgatcgcgctcgtcaaccgcaacccgatgggcaacggcgtggggctgttcacgcagagcggcgcggcggcacgcaagttccagagcgagatcgacatcggccaggtcggcatcaacatcccgattccggtgccggtgccctacttcagcttcacgggttcgcgcggctcgaagctcggcgatctcggcccgtacggcaagcaggtcgtgcagttctacacgcagacgaagacggtcaccgcgcgctggttcgacgacgacgcgacggccggcggcgtgaacacgacgatcgcgctgcgctgagcgagggcatgtacatggacatcgcattcatcggactcggcaacatgggcggccccatggccgccaacctgctgaaagccggccacgcgctgacggtgttcgacctcgacgcgcacgcggtcgacgtcgcggtgcgcgccggcgcgaccgccgccggctcgccgcgcgaagcggcgcgcgcggcgcggtcgtgatcacgatgctgccggccgcgcaacacgtgcgcgcggtctatctcggcgacgacggcgtcctggccggcgcgcacgccggcgcgacgctgatcgactgcagcacgatcgatcccggcaccgtgcgcgcagtgaccgacgccgccgcgcagcgcggcttcccgctcgccgacgcccccgtgtcgggcggcaccggcggcgcgcaggccggcacgctgaccttcatggtcggcgcggacgccgcgctgttcgagcgcatccgccccgtgctgctcgacatgggcaagaacgtcgtgcattgcggcggcaccggcaccgggcaaatcgcgaagatctgcaacaacctgctgctcgggatctcgatgatgggcgtctcggaagcgatggcactcggcgccgcgctcggcatcgatccgtccgtgctggccggcatcatcaatacgtcgaccggccgctgctggagctcggacacgtacaacccgtatccgggcgtgagcgacaccgcgccggccgcgcgcggctatgcgggcggattcgcggcgaacctgatgttgaaggatctcgggctcgcgaccgaagcggcacggagcgcgcaccagccggtctggatgggcgcactcgcgcagcagctctatcagtcgatgagccagcaggggctcggcacgctcgacttctccgcgtgcgtgaagctgtacgaggcgcagccggcgtaaccgccatagccgaggccggacgtgcgccgacccgcgatgtgcctgtacggcctcgcgggtcggtttgcatcggggagaaggaaaacgcacacggcggcgtgcgacgccgccggtcgctcaaccgcgcggattcgacgccgtctcgaaggtcggatggcactcgaacgcgagttcggagcgcgcgccgacacggctgccgctggtcagcgcctcctgcttcaggctggcgcgcatgccgcgctgcgtgcagtagttggtggcttcgtcgacggccttcgtatgggcgtcggcccacgtcgtcgatacgccgaccgtgcgcgtcgtcacggtaaatacgttcgggttcgacgtcgcggtcacgtcggaagcggtcgaacacgcggcgagcaagcatgcagcagccgcgacggtcaaccatcgcagggttcgaaaggaaactggagtggacatgggggcaagcgcacgtacttcgacgtgcattgagcaacataggcgacagtatgcctgctcgatcgccggagatcatgcccctttcggtgaacacattgtttcgaatggttaaacgatgacgggtgcaggcaagatttacagccctcgccggcggccggcttcggccggcaggtagtttcgcccggcgcgacggccggagcgagccccgccggccgggtcggcgccgacgcgtccccgcgcccggctcctgcgacaccgcccttttacaacccgggcgcccctctctctccctgaccggccccgccccgcacccggccgcccggcgccccgtcgtcagacaggcacatcgcttgcgccatccacgcgcccgccgatccggcggacaacatccttccgcaaccggcgttgctcaccacgcgaccttcgcgtggcgatcccgcatcgcaaacaggttcccctgaacgagaggacaacatgaaatcaatacgaacgatagcggccctgtgctccatcatttccgtgctcgcggcatgtggcggcgacggcaacgacgtcggcaccgagctcggcatctcgaagccgcaggcgcgcttcatcaacgcggtgccggccggcccgaacctcgactactacctgaacgccaaggtcgaccagtcgggtgtcgcgtacaagggcgtgacgcgctatcacgacgtcgactcgggcacgcagaccgcgagctacgacatctcgggcacgacctcgaccatcgcgtcgcaatcgttcagcgcggcgaacggccatcactacacgacgatcgcgctgccgagcacgacgtcgctgatctccgtgatcgacgatccgtacgacaagggcctgctgtcggacaaggcgcgcgtgcgcagcttcaatgcatcgccgaacgcgcagaacatcgacatgtacgtcgtcccgcccggcaccgacatcacgacgcaaagcccgacgctcgcgggcgcggcctaccagaacgcggtgccggcctcgacgcaggattcgatctacctgaacggcggcagctaccaggtgatcgtcacgacggccggcagcaagacgccgatcctcaagaccgcgccggtcaccatcaacaacaacgccgactggctgctgctgacgattccgtcgggcggggtcggcgacgtgacgccgaacgatatccacgtgctggttgcgcaaggcaacgacgccgatacgtccgcgcaggaactcggcccgcagtaaaggcgcgaacacggcggcggcgatcgtggcggccggtgcgagtgcaccggccgccccacgccgggtaccggtatccggcggtatcagtcgatccgctcgaggcagatcacgtgctcggcgcgcgcaccgtcgccgtgctcgacgtcgacatcgccgacatgccgcacgcgccagcccggccgcgtcgcgatctgcggcatgttgccgcccggccggctctcgatcccgccgagcccctcgtcgggcgtatcgaccgcatcgtcgagcgacgcgttcgagtagatcacgttgtcctgcagttccgacgcgccggtgcgcgcctccatgcccttgccgtcgacgtcgaccgtgttgtcggtcatcgccatgttcgcgttgtcgagcgtgacgatccggccggccgcgcgacgcacgggatcgccgctgtcgaccgcatgcgcgccgacgtcgatcggcggcaggccggtcggcgttttcgccgcgaccgcctcgggcgtcagcggccgcttcgccacctcggcggcctgggtcgccgcgtcgggcatgttgccggctgccggggtcttcaccggactcttcgcgatctgttcctgctgctgttgcggggttggattcgattccgcgttctgcatcgcacctcctgttccggacggcgtgcgccggcgtgatgccggcgccggtccgggaatcgctacaacggtccttgcaaatctttcacgcgcaggtacggcgcgcacgcgcgtcctgcggcgcccgtgccgcatgggcatgccgcacgacagcgcacgggcgacgaaccggcgcacgccgcgtgcacgtgcgcgtgcgccgcccgcctgatgccggtcagccgccgcttgcgcccgccggcgcggaggccgcgcccggcatgcttgccgcgccgcccggcgtgcccgacggcgcggtggacggcgccggcgacatgccgcccgtggcgctggtgtccgagctcgcaccggtaccggtgtcgctcttttctggcaacccgcacccgccgccaggccggcgatcaggatgccggcgaagacggctcgcgatacgtgacgaagggaatatcgctgcatgacacctccgctgatgtcggtggatggaaccctacggcgcgcaatccccgtgcctcgccgtcgatccctcccattcatttttcaaatggcgcccagccgaatatttaatttcccatcaccgtgccggccacccatactcgccaacaaatccgagacataacgtccacggcggccgggccgtcgcagcgtatacgcgctgccggtttcgcgccccgcacatggaaggagacaacggcgtgcaactggaagccacccaccgcccgggcatcgtgcccggcgcggtcgacgcatcgcatcgaaccgattcggccgcgcgagaccccgcgctgagcccgcggctgcacaaccccgacctcgcgcccaccaaggccgaggggcggacgtggggccgctacagcatctttgcgctgtggaccaacgacgtgcacaacatcgcgaactactcgttcgcaatcgggctgttcgcgctcggcctgtcgggctggcagatgctcgcgtcgctcgcgatcggcgcggtgctcgtgtactccttcatgaacctcaccggctacatgggccagaagaccggcgtgccgttcccggtgatcagccggatgagcttcggcatctacggcgcgctgctgcccgcgatgatccgcgcggtgatcgcgatcgcgtggttcggcattcagacctatctcgcgtccgtcgtgctgcgcgtgctgctcaccgcgatctggccgggcctcgccgcgttcgaccaggacgcgatcttcgggctgtcgacgctcggctgggtcacgttcgtcgcgatctggctcgtgcagatcggcatcctcacgtacgggatggaaatggtccgcaagtacgaagggctcgccggcccggtgatcctcgtcacgacgctgtcgctcgccgcgtggatgttcagccgcacgggcggccatctcgcgatgtcgatcggcaagccgctgaccggcctgaagatgtggacggagatcttcgcgggcggctcgctgtggcttgcgatctacggcacgctggtgctcaacttctgcgacttcgcgcgctcgtcgccgagcgcgaagacggtgcgggtcggcaacttctggggcttgccggtcaacatcctcgtgttcgcgacgatcagcttcgtgctcgcgggcgcgcagttcaagctgaacggccacatcatccacagcccgacggaaatcatcgcgacggtgccgaacaagctgttcctcgtgctcggctgcctcgcgttcctgatcgtcacggtcgccgtgaacatcatggcgaacttcgtcgcgccggccttcgtgctgacgagccttgcgccgcatcgcctgtcgttccgccgcgcgggcctgatcagcgcgacggtcgccgtgctgatcctgccgtggaacctgtacaacagcccgatcgtgatcgtctatttcctgtccggcctcggcgcgctgctcggcccgctgtacgggatcatcacggtcgactactggctcgtgcgcaagcagcgcgtgaacgtgcccgacctctataccgaagcgccgaccggcgcctatttctacacgcgcggcgtgaaccgcaaggcacttgcggcgctcctgccgtccgcgctgatctcgatcacgctcgccgtcgtgccggccttcagcgcgatgacgccgttctcgtggctgctcggcgccgccatcgcgggcagcgtgtactggctgctggccgatcgcaaacggcaatacgaggagcgctcgggcgagcccatcgcggtcgcctgcgcgcaacactgaacacacgcatacggagtcagcaatgaggatcctggtagtcaacgtcaacacgaccgagtcgatcaccgacgcgatcgccgcgcaggcgcaggccgccgcatcgccgggcacggagatcgtcggtctgacgccgcgcttcggcgcggagtcgatcgaaggcaacttcgagagctacctcgcggcgatcgccgtgatggatcgcgtgctgagctatgacgagccgtatgacgcggtgatccaggccggctacggcgaacacggccgcgaaggcctgcaggaactgctgacggtgcccgtcgtcgacatcaccgaagcggccgcgagcgtcgcgatgctgctcggccatcgctactcggtcgtcacgacgctcgaccgcacggtgccgctgatcgaggatcgcctgaagctcgccgggctcgacgcgcgctgcgcgtcggtgcgcgcaagcggcctcgcggtgctcgaactcgaggaaaacccggcgcgcgcgatcgagtcgatcgtcggccaggcgcagcgcgcggtgaaggacgatcacgcggaagtgatctgcctcggctgcggcgggatggccggcctcgaccggcagatcgaggaatgcacgggcgtgccggtcgtcgacggcgtatcggccgcggtcgcgctcgccgagtcgctggtgcgcctgaagctgaagacgtcgaaggtccgcacgtatgcaccgccgcgcccgaagcggatcatcggctggccgggcaccttcgcgaaatgacgcgccgccggccggctgctgcatcgcgctcgggcatcgtgtcgccgggagacgtatcggcatgcgggacacgctagaaccggacgcactgccccgcggcgcgtccgacgccgcgggcgcgctcgacgtgctcgatgcgcggctgatgcgcatcctgctcgtgctgctcaccgagcgcaccgtgtcgcgcgcggccgtgcggctgaacatgtcgcagccggcgacgagcgccgcgctcaagcgcctgcgcacgctgctcggcgatccgttgctggtgcgcagccgctacgggatggtgccgaccgagttcggcgcgcggctgatcgaaccgctgcgcaacgcgctgcgcgtgatcgacttcatccgcatccagcagccgacgttcgacgcgcgcacgtcggtgcgcacctaccggatcggctgccccgactacctgaacgtgctgttcgtgccgaagctcgtcgcgctgttccgcgaacgcgcgccgaacgcgcagctcgtgttccatccgctcggcgacggcttcgacgacgagcgcgcgctggccgacggcgaactcgacgtcgtgatcgacaatcgcccggcgcgctcgtcgcggttccggcaggacgacctgttcgacgatcgcgtcgtatgcctgatgcgcgcgacacatccgctcgcgcggcacggcgcgatgacggccgccgattttgccgacgcgccgcagctgtgcccgacaccgtcgtggctcgaggcatccggcgcgatcgaccggcagctcgaacgcgtgggcctgcagcggcggatcgtcgtcacgctgccccacttcgaacttgccgcgcatgcgctcgtgcgcaccgacatgctcctgaccaccacgtaccggctcgcgcggcattatgcgaagctgctgccgctcgccgccgtcgcgctgccggcggagccgccgggcatcgtgtaccggatgacgtggaacgaatcgggcgcgtgcgtggacggcgtgcgccggctgcgcgggctgatcgcggaagcgacacgcgcgtggctcgacgccgaggcgatgctgccggcggttgccgcggttcccgccggcgcagctgcggacgcagggaacagcgtgacggctgcggccgatacgtccgatgcacccgatacagccgatacgtccgatacgcccgaaccggttcgacgcacgcgccgcaggcaggcgaaacattgccgtgcatcgcacccgccgcgcgtcgcccatgcggcacgcatccaccgtcacgcgacgaagtcgcattgaccggcgcgaccgaccggctcgacaacgcgccgctccatacatcacacactttcacgcaccgtcacgcagcatcgcgcatcggttgcgcaagcaacttccatgcgacgacggccacgacgagcgcgagcacgccgctcaccgtcagcgcgttggcaaacccgctcgcgaacgcgacgggcgccgccttcgcgagcgcgccggaggccgacggcggcacacgctcgagcgcccgcgccaggtcgccggccaacaggctcgacatgaacggcgcatcggcgaacgcgcgcaggccgggcgcggcggacagcagccggtcgagccgcgcctgcgtgctcgccgccagcaccgcgccgagcacgccgacggccgtcacgatcgccgagaagcgcgtcgtcgtgctgatgcccgacgccatgccggtgcgattcgacggcacgcacgccatgatcgccttctgcgtatcgccgttcatgatgcccgcgccgcagcccgtcacgaacatgccgaccgcgacgagccggtagtcgccggcggccgtcagcgccgcggtcgcgaggttgcccgcgccgatcagcgcgagcccgcccgccagcacgccgccggacgacacgcgcgcggccagcgccgcgccgagcgacggcccggcgatcatcgcgaacgcgaacggcagcatcccgagccccgcgtcgatcgccgacatcccgaacgcgttctgcaggtacagcggcaggaacgtcatcatcacctgcgcgcacgccgcataaccgaacatcgcgagcacggcgccgacgaagcgcggctggcggaacagcgcgagatcgatcatcggccgcgcctgccagcgctccgcgccgacgaacgccgcgaacagcgcggcggcgagcgcgagccggccgagcgtcgcggccgacagccagccgtgcgacggtgcgccgatcagggccgcgatcgcgcacgcgagcgccgcgccgaacaacaggctgccggccgcatccacgcgcttcgcgtgcggatcgcgcgactcgtcgatcgcgacgcgcgcgccggccgcgagcagcatgcagacgggcaggttcagcaggaacacccagcgccacccgatccattgcgtgatcgcgccgccgacgagcggtgcgacggccgtcgcgatccccatgcacatgccccagatcgcccacgcgcgcgcccgctcgcgcccctccggaaaacggttcgcgatcacggcgagcgcggccgtcagcaacagcgcggcgccgccgcccttcaccgcacgcgcggcgatcagccagccggccgacggcgcgacgccgcagccgagcgacgcgagaaagaacagcgcgagccccgcgccgagcatccgcttgcgcccgaagcggtcggcgagcccgccggccggcagcaggcaggcggcgaacgcggtcatgtacgcgctcacgacccattcgatatcggcaaagctcgcgtggaaactgcgcgcgatgctcggcagcgacacggcgacgacgttcgtgtcgagcacgatcagcgagcaggtcgcggacgcgaccgcgagcgtcgcggcggcgggcatgctgccgcccgtgcgcgggcggcagccgcgcccgcgcgcgacgccggtgaagactgggacatcggacactccggaacaggttgaacgaaccgtatgctaggcttgcccggtattgcccgtcattgacactcagacgctttttattgacgaaaactgcaatcatggatcggctcgaattccgtcacgtgcgcgcgttcctgagcgtcgcgcagcacctgcacttcgcccgcgcggccgaggcgctcgacatggcgccgcccgcgctcacgcggcagatccaggaagccgaacgcgtgctcggcgtgcgtctctttcaccggtcgcgccgcgcggtcacgctgagcgcggccggcgaggcctatctcgccgaagcgcgcgccgcggtcgaacacctgcagcgcggccgcgaactggcggcgctggccgagcgcggcgagctcggccggatcgagatcggctacgtgtcgtcggccgtctattcgggcacgctgcagcgcacggtcggcgcgtttcgtgacgcgcatccgcgcatcgaactgaacctgcgcgaagtgccgatggacgacgtcgcgaaccagctcgacgccggccgcctcgacctcgcgtacgtccgcccgccgctgccgctgcccggcggcctgcggatcgtcacgctgcagcgcgacgtgttcgtcgcggccgtgccggccgagtcgcgctacgcgtcgatggccgccgttcgcgcggccgacctcgccgacgcgcgcttcgcggtgcccgaacaggagcgcggcacgctcgaagtcgcgcgccgcggccgcttcgcgccgctggtcgccgcccgcccgggcggcttgctcgcggtgctcgcgtgcgtgtccgtgaacggctgggtcgcggtgattcccgatgcgctcgccggctgcgtgtcgctgccgggtgtcgtgtaccggccgatcgccggcaagccgatcacgtcggaactcgcgctcgcgcaccggcgcttcgaaaaggcgccggcagtgcgcgcgttcctgcggacggttccgtcggccgcgcaagacgctggatgaaacgcccgcgtgcggcgatggcggcgatggcgaccgccgcggcgcgaatatgcattgcacgattcgatgtttgtcggctggaaaccgattccgtaacctgcccggcaaccgcgccacctgcgcgcgggtaaccgaggacactccgccgatgaacccaacttccgccccggcgcgccgccgcgtgctgcagcgtcttgtcgccctcgccgccgcgccgctcgccggcggcgtcgcactgcccgcccatgcggcgggcgccgacccgtcgggcgtcacgctcgtgctcggcgaccaggccggcggcctgcgcgcgctcgccgaagccgcgcgcgtgctcgacggcacgccttaccggttccgctgggccaacttccagggtgccgcgccgctgttcgaggcgcagcgcgcgggggcgatcgatctcgcgccggccggcgacctgcccgtgctgacggccgcgctcggcgatccgtcattgcggatcgtcgcgacgcgcgtcggctcggcgacatcgctcggcatcgtcgtgcagcccgattcgccggtccgcaccgtcgccgacctgaaaggacagaccgtcgtcgtgtcgtccgcgcgcggcagcatttcgcagtaccagctgtacggcgcgctgcgcgaacacggactcgcgccgcgtgacgtcgacgtgcgcttcgtgctgcccgtcgacgcgttcgccgcgttcgaggcgaagcggatcggcatctgggcgacgttcgacccgtactacgggcatgcggtacggcgcggcgcgcgcgtcgtccgtgacggcagcggcatcaattccgggctggcgttcctcacgtcgccggtcgaaacgctcgacgatcgcgcgaagcgcgcggcgctcgcggacgtgctggcgcggctcgcccgtgcgggccagtgggcgctcgcgcatcccgccgactatgcgaccgtctatgcgtcgctcacgcgcctgccgcccgacgcggccaccgacatcgcgcgccgggccgcgctcgcgcagcgcagcctcagcggtgccgacatcgacgtgctgcagcgtgtcgccgaccgcgcggcggccgacgcgatcctgccgcggcgcgtcgacgtcgcctcgatcgcgatccgcaacgtgtccgcctgaacggtgacgcgcgtggcggcgttcagcgcggccgcggcatgtcgagatccggcatgtcgtcgaacgtggaggcaacgagcgtgcgcatcgcggcgacccgcagcgtcggccccgactggttgaacgcgcagcgctcgcccgcggctggcacggcccggtgcagcacggcccgccacgcgccacggccgccctcgcgttcgaaagcggcgaacggcagccgctcgacgatcgggccgccgtccgtccacgatgtcgacggcacgaacggagccggcgccgcgcccgccgcgcgaatcgacgtacacccggacgcatcggcgcgcggggcgtcatggccctgcgcgaccgcgacccagtagtccagcggcgcgcctgtcagatcccggacttgcatgcccgtcaccgtcgttatcgaatcgacatgctgaccgttgcatctgcggcggttgcggttcccgatggcgccgaagcgcgctgccatatcgctgaaatccctccccgagcaaacccgcgcacgttgtcacggccgcgtcactcgtgcgtacaatgatccgaccgcttgccgccgccgttcacggcaaacgaatcaggacattacaaacagagaacacacaaaactgcgccgatccggagctgtttccgggagttcggcgacatcaggaccagacaatgcggcgcagacctgatctcacgggggacatatgtccaggcacacccgaaagccgttggtatcgctcgtcgtacccttccatgacgaggcggaagcgatcgacgcattctttgcgactgcccttcccatcctcgaatcgatcgacaccacgcgcttcgaaatcgtttgcgtgaacgacggcagccgcgacgacacgctggacaggctcatcgacatcgcagccggcgacccgcgcgtgcgcatcgtcgatctcacccggcgcttcggcaaggaagccgcgctcaccgccggcatcgacgaagccgccggcaccgccgtgatcctgatcgatgccgacctgcaggatccgcccgctctaatccccgcgatggtcgaacgctggctcgccggcgccgaggtcgtcgccgcgaagcgcaccgaccgcatgtgcgatccgctgatgcagcgcgtggccgccgcgctctactaccgcgtgcacaaccgcctctccgaagtcgaaatgcccgagaacgtcggcgatttccggctgatggatcgccaggtcgtcgacgcgctgcgcgcgctgcctgaacggcggcgtttcatgaaaggcctgttcgcgtgggtcggctatcgcaccgagatcatcgaatacacgcgtgccccacgcagcggcggccgctcgaaattctccggatggcggcgctggaacttcgcgctcgaaggcatcaccagcttcagcaccgtgccgctgcgcgtatggacctacatcggcctcgcgttcgccgccctctcgttcatctacggcacgttcatcgtcatgcgcacgctgctgttcggcaaccccgtgcacggctacgcgtcgctcatctccgtaatgctgttcgtcggcggcatccagctgatcggcatcggcgtcatcggcgaataccttggccgcatctatcacgagtcgaagcagcgccccgtctatctcgtccggcgccgttaccgcgccgccgccctggtgggccaacatccggcgcggcacgtcgcgcagccggatgcctcgaagctgctgccgtttccggttcggcgcgtcgcccctgcccgacgacggcagacggccgccgtgaccgcggcagcagcacgcaacctgtcggtcaagtagcgcagcatggatatttccagctcatcgattcaagctgacgaacgccctgtccgcgtctggctgacgcccggacgcatcgcgctttacagcgcggtcatgctcgcgatcggcgtgctgttcgtgtcgatcatggtccgggtcggcttccactcgcccgacccgggcctgttccgccccggctcggggttcacggtgttctggtccgcgtcccatctgatgcgccatggctcgccgtggcaggtctacgatgtccccgcgttttcgcgggcgctcgccgacctgttcccgatcacggccggccatgcgttcctgccgtggctgtacccgccttcatatctgctcgtggtggcaccgttctcgctgctgccctatgcgatcggctatccgctgttcatcgcgctcggcatcgtgctgctgggcgtgtcgacctggcgcgtgtcggggctcgcggcgacgcccggcgcgaaacgtatcgcctggctcgcgctgctcgcatgtccgggcgtgctcgtcaccgcgacgtacggacagaacgcgatgctgactgcgacgtgcgccgcgctcgccgtgcatttcgtcgatcgacggccaatgctggccggcttctttatcggactcctgtcggtcaagccgcaactcgcgttgctgttcccgttcgtgctgatcgcagcgcgtgcgtggcgcgcattcgcgtgggccgcggcctttgcgactgccttcaccgcgctgggcatcgcgacaggcggcatcgaatcgctccatctcttgatgcagaacgcgggcgcgctgcgttcgctgatcatcgagcatggcgttccgttctggtttgcgtcgccgacgccgttcgcggcgtttcgtctcgccggcctgtcgccggcgctcgcctatgttgggcaggccggcatcgccgcggttgcgatcgcggccgcgtgcttcgtctggcatcgccaccaggatgcgcggctgcgcgtcgcgacattgttcatcgcgacgctcgccgcgaatccctatgtctggcactacgaactgtcctggctgtgcgtcccgatcgcgtgcatgatcgccatcggctcgcaggacggctggctgcgcggcgagcaaggtttcgtggccatcctgtgggcgctgccgctttacgagtttctgaatccgtggatgcatctgccgcagatcgggccgctcgtgacgtcgatcgcgctgctcatgctgctgcggcgcggacggtttgccagtcgcggtacgcgcgccgcgctcgttcgcgccccgtgagccgatagccgcgcaccacgccggcaccctgcccgtgccgactgctgcgctcggcaatcgcgccccgggtcgcgctcgggcagcgtcggtggcaccgtcgacgtccggcaagtcaggctgacgcccgccccaccaccacacccacatcaattcgtgttacgaatccccgattcctgcctacaatgatcagaacgcctgtcgtccggcctgcagcggacgacgacctgatccatacggcgcagcacgagccggatctctcggggacgtatgtccgcgcacgccagaaggccgctggtatcgctcgtcgtaccgttccacgacgaggcggaaacaatcgacgcattctttgcggcaacgctgcccatcctcgaatcggtcgatacgatccgtttcgagatcgtctgcatcaacgacggcagccgcgacgacacgctggacaggctcatcgacgtcgccgccggcgacccgcgcgtgcgcatcgtcgatctcacccggcgcttcggcaaggaagccgcgctcaccgccggcatcgacgaagccgccggcaccgccgtgatcctgatcgatgccgacctgcaggatccgcccgctctgatccccgcgatggtcgaacgctggctcgccggcgccgaggtcgtcgccgcgaagcgcaccgaccgcatgtgcgatccgctgatgcagcgcgtggccgccgcgctctactaccgcgtgcacaaccgcctctccgaagtcgagatgcccgagaatgtcggcgatttccggctgatggatcgccaggtcgtcgacgcgctgcgcgcgctgcccgaacggcggcgtttcatgaaaggcctgttcgcgtgggtcggctatcgcaccgagatcatcgaatacacgcgtgcgccacgcagcggcggccgctcgaaattctccggatggcggcgctggaacgtcgcgctcgaaggcatcacgagcttcagcaccgtgccgctgcgcgtatggacctacctcggcctcgcgttcgccgccctctcgttcatctacggcacgttcatcgtcatgcgcacgctgctgttcggcaatcccgtgcacggctacgcgtcgctcatctccgtaatgctgttcgtcggcggcatccagctgatcggtatcggcgtgatcggcgaatacctcggccgcatctatcacgagtcgaagcagcgccccgtctatctcgtccgccgccgttaccgcgcgcagcggacgccgccgcgcatcctgcgtcgaagctgctgcagttcccgctcaagcgcacgcacgcggcccgccgccggacgccgctcccgcgactgccgccggccacggtgcgcgcaaagtctccgtcaagtaaccgcgtacacgccgcatggatctcgcccggcaaacgatgcgatcggcggaccatcccgtccgtgcatggctgacaccgcggcgcgtcgttgcgtacagcgcggtcgcgctcgcgtgctacgcgctgttcgtcgcgatctgggtatccgtcgtccgtcatgcgccggccaccgccttgtcgcgcccgggccccgactacgcggtgttctggacggcgtcgtacgtgatgctgcacggctcgccgtggcaagcgtacgatgtgccgaccttctcgcggctggccgccgagctgttcccgcagttccgccgcgacgacctcgtcgcgtggctgtacccgcccaccaacctgctgctcgtgacgccgctcgcgctgctgcctttgcgatcggctatccgctgttcgtcgcgttcggtgtcgccgtgttcggtttcgccgcatcgcgcgtatcgggcctcggcgcgatccgcggcgcagggcgcgtcggcgggttcgcgctgatcgccgccccgtgcgtgttcgtcaccgggatgttcgggcaaaacgcgttcctgaccgcgtcgtgcgcggcgctggccgtctgctgggcggaccgccggccgatgtgggccggcctctgcatcgggctgctgtcggccaagccgcaactggcgctgctgttcccgttcgtgctgatcgccacgcgcgcatggcgcacgatcgcgtgggccgcgctcgccaccaccgcgttcgccgcattgagcgtcctcgtctgcggcgtcgagtcgctccatcggttcgtcgccggcaccgcgctcgcgcggtcgctcctcctcgagcaaggtgtcgtgttctggctcgcgtcgccggcgccgttcgccgccttccggctcgcgggcctgacgcccgggctcgcgtatgccgcgcaggcatgcatcgcggcgccggcgatcgcagccgcctgcatcgtgtggacgcgctcgcgcgacctccgcttgcgtgccgccgtgctggcggtcgcgacgctcgcggcaaacccgtacgtgtggcactacgagctcgcgtggctcggcatcgcgatcgcgtgcatgctggcgaccggctggcaggacggctggctgcgcggcgagcaggccgcgatcgcgctcatgtggctgctgccgatcgtcgaatacctgaacccgtggctgcaatggccgcagatcggcccggccgtgacgctatttgcgctcctcgtgctgctgcgccgcgccggcccgcgtgctcacaacgcgagccgcggcggcacgtagacgccgtagtacggcccgacgccggtcccgacgcccgtcatcttcacgccggcgacgaagtggccctggatgtacttgtacgtgccgccgagcgacacgtcgatatggaacggcgcgaacgcgacgatcggcacggtggtgctggtcgcggtctgcgtgacgaccggcagcaccaccgtcgcgccgaccggcaccgacgtatagagcgtcgccttcacgccggtcgcgagattgatgctgtcgccgatgttgagcgccgtcgggttgccggtcgccatcaggttgcccatcgtcgtcgtgtcggtcgcggtcgactggaacgaggtccactgcccgcccatgcagagcaggccgtagacctggccgttcgtgatcgagaactcgtacggctggccggtcagcggattgatcagcggctggttggtcgcggcgttccagtacaggttgtacacgcactggtcgatcgcaaccggaaacagcgcgccggccgccaccccgcccggcgccgccagcaccgctaccgcggtcgcgctgccggaggcgccgggaatcccgagcagcccgccgagcagcagcggaatcgagccgccgttcacgccgggcgcgcgcgacacggtgacctgcaccgccggcacgtcgtaggtgccgggcgtgatggtcgtcggctgcatggatgcgggattgcgcgtcacgttccagtatccggtggtcaccgtgccggtcgacagcgtcgcaccggccgccgagttccgcgcgatcacgccgttcgccgccggcgcggcctgcgaccagttcaccgcgccgccgctcggcgacatcattgcatcggccccgcgagcgcggccgcatcggccgcgttctgcaactggttgttcaccgtgaccacccacgcgatgtcgatcgccagcgcgccgaacgacagcagcggaatcaggaacatcaggaagaacagcgcgaccgaaccgcgctgccgcgcggggccggcgggttgcgtcgcgcacacgtcattcatagagcatcaccgaagtcgccgaaaccgtcaccgggccggtgagcgcgctgaacgcggaacccagcacgagccccgtatacgtgtaggtcacggtcaccgtcagcgcggtgcccgacgtcgtgccgttcgcctgcgtcacggtcaccgccggggtggtcgcggtgccgccggtgatcaggctgttctgcatcgcgttctgcgcgatgcccgcgatctgcgtcgtggtcagcatcggcacgcgcagcacgacgccggcccgcgcggcctcgcggctcgcgttcgtgatgacggccttgtcgcacaggatcaggctcgtgtcgatgatgccgatcagcaccatcagcaggaacggcagcatcagcacgaattcgagagacacgacgccgcgcgcggcgggcgccggtcgccccgcgtgtcattttgcggcccccgcacccggcggtgcgacgcccggctccagcgccgcgccggacatcggcggcgcggcaccggcaccaccggcactgccgccgcccccgcgcgacgcgagccgcgcgcgcaccgcctggtagaagcgcaggttgtcggccaccgccgacgcgggcaaatccgcggacagcagcttcttcgccgaatcggtattgccgagcacgccgtacgcgaacgcgaggttctggcgcgcctgccacggcgcggacggcagcccggcgacgtcgagcagcacgttcacgccttcgcgcggccggttgctcagcacgagcgacagcccgaggtcgacgcgcagcccctgcgcgtccgggtgcgcgcgcagcgcgtcgcgatagacgacctgcgcatccgcatgacgcccctgcaggtcgagcacggtgccgagcccttccgccgcgagcggatggttcggctgcgcggccagcaggtcgcgatagcgctgcgcggcttcgtcgagacgccgctgccgcaacgcgacgcgcgcgagcccgagccgcgggccgagttccgcgggcgcctgccgctgcgcctcgtcgtagagaatccgcgcgcgctccaggtcgcccgcgcgatagttgacgtcgccgagccccaggcgcgccgcaagcgattcgggatgcttcgcgagcaccttctcgtacagcgtcgatgcgagatcgacgttgccgccggcgagcgcgctgtccgcgatgcgcagctcggcctgcgggtcgtcgctcttgtgcgacagcaccggccgcgtctggatgcccggcgcgcagccgccggccagcaccggcagcacggccgcgagcgcgaacgcacgtacgacggatcgtgtcatctgaatacctcgagcaggcgaatcgccgccgggcccgccgcgatcaggcacaccgtcggcaggatgaacagcatcatcggcaacgtgatcttcggcgccagcttcgcggcccgttcctcgagcgcgacgatctgctcggtgcgctcggtgcgcgacagggtgcgcagtgcctgcgtgatcggcgtgccgaagcgctgcgactgcgtaagcgtcgtcgcgagcgaacgcgccgacgtgaaatcgacgcgcgtcgcgaaatgcgcgagcgtcgcggacacgtcgccgctcagcgtgagctcgtccgcgcacaccgtcagctcgtcggcgagcggcgggcagatgcgcgacagttcgtgcgcgacgcgccggatgcccgacgcgaggctgttgccggccatcgtgcagatcaccagcaggtcgagcgcgtccggaaagcacgcggcgatgagccgccgccgccgccggatcatcgcgccgagcacgtattccggcacgatcacgccgaccacgaacgcggcgaccatcgccagcgcccggatcacgaagtattcgccgaagcgcggaatcagcgggctgaacacgatcgcgccgcatgcgaacagcacgccgcagctcagcttgatcccgatcatcgacgacaccgcgcggcgctcgcgaaaacccgcgcgcgtcagttgcaggccgagcttcacgcgctgcatcgggtcgagcaccggcagccgttcgcccagctgcgcgagccggcgcgtcaggtcctggcgaaggccgcccggctgcagccaccccgtcacgggtgccggcgggtgctgcccgctgcctgccgcacacgcgcggcgatccgctggcgggtgccgccgccgggtctgccgagcgccgccgcgacacaggcgagcaacagcagcaattcgaagccgcgggcggccagtatcgacatcgtcatcgcgcggtatccagtttcgagatcttgcggatcaccagcaggccgaccgtcagcaacccggccgcgatcgtcagcatcgtgttccctgcgtgcgtcgagaacagcagcatcacgtagtcgcggttcacgaggaacagcgcgccgatcatcacgaacggcaccgccgaaatgatgttcgtcgtgatgcgcccctcggcggtcagcgcgcgggtcttcaggcggatgtcgcggcgcgtgcggatgatgctcgacagctcgtcgagcgtttcgccgaggctgccgccggtctcgcgctgcagcagcaggtagacggtgaagaacgagaagtccgcgatcatcagccggtccgccgcctgcgtcagcacgtccttgagatccgcgccgacgcgcaggctgtcgcccatcgaacggaacgtcgcgcgcaccggttcggccgcgccgtcgccgaccatgccgatcgcctgcgtgaccggaatgcccgcgcgcacggcccgcacgatcacgtcgatcgcgtccgggaacgcttcgagaaagcgcacccggaagcggtcgaccagcgcacggtagctggcgcgcatcgcgaccagcggcaacccgacatagatcagcggacgcaggaagtccggcggcccgatcagcttcaccgcgacgatcgccgcgatcgcaccggcgatcgtgctcgcgacgacgatcctcaccccgcccttgccgcctaccgcgcgcacccgcgtcacgcggcgttgcagccatgcgcgcaggcggccttgccggcgctcgaggttgaacagcgcaacgccgggcgcggcagacgcgtgcccggcgtgcccggcgagcgacggcgacagcttgcgcatccgtgcgcggatgcgctgcgccgggtgatggctcgcgcgatcgaacagcgacgacagcacgagcccgatcgcgaggatcgtcacgaacccgcccgccgcgaacaggtcggcggccctcattgccggaagacctcggcgagcgcatcctcgacgccgtaatacgcggcgcgcgccgcgaatcccggccgcaacggcgatgcctcgaacacgcccttcaccgcatcgcgcgtcgtgtcgccgtcctggcggaacacgaacaggtcctgcgtgatgaccacctcgccttccatcccgacgatctcggtgatccgcgtcacgcgccgcaccccgtcgcgcatccgctcgatctgcacgaacaggtgcacggcgctcgcgatctggcggcggatcgacagcagctgcaggttcgcgttcgccatcatgaccatgctctcgagccggctgatcgcgtcgcgcggcgaattcgcgtgaatcgtcgtcatcgagccgtcgtgccccgtgttcatcgcctggagcacgtcgaacgcctcggggccgcgaatctcgccgaggatgatgcggtcgggccgcatccgcagcgcgttgcgcacgagatcgcgctgcgagatcccgccgagccctcggtattttccgggcgcgtctcgaggctcacgacgtgcggctgcagcaactgcagctcggcggcatcctcgatcgtcacgatccgttcgtgctgctcgatatgctgcgacagcgcgttgagcagcgtcgtcttgcccgagccggtgccgcccgagatcacgatgttcagccggcacgcgcacgcgaccttcagcacctgcagcatcggatgcgagatgttgccctgctgcgccatccgcgcgagcgtgatgtcgcgcttcgcgaacttgcggatcgagatcgacgggccgcgcatcgcgatcggcggcagcacgacgttcacgcggctgccgtcggcgagccgcgcatcgaccatcgggctgctctcgtcgacgcgccgccccaccgccgccgcgatccgctgcgcgacgcttgccacgtgcgcgtcgtcgcggaacttcagcgacgtgagctcgagccggcccgcgcgctccacgtacacctggtcgggcccgttgacgaggatgtcggtgaccgtgtcgtcggccagcagcggctcgatcggcccgacgccgaacatgtcgttcaggatcgcatcgacgatcagcacctgctcgccggccgtgatcttcaggcgctcgcgctcgaccgtgtgcgcggccacctgctcgatgcccgcgcgcacctcgtcgcgcgtcttcatcagcgccgccgacatgttcatcgacgtgaacaccgcgtggcggatcgcgtcgaacttgctcgaccggatcagcgcctcgtgagtatcggccgccacgggcgcacgggccgatgccgacgcgggtgcaggtgcttccgccggagccggagccggtgccggctcgtgcgccacggcaggcgtcgcggccggcacggggttcaccggcggccggttgcgggtaccgaacgtcacgatcccttcctccacttgacgagccgcgcataccacggctcggcgacggccatcggctcgcctgtgatgccgttcgcgagctgccggatctgatccacgaagccgtgccgcttcgcgccttcgatcggctcgccgaggttctcggcgacggcgagcgtctgcggctcgtgcggcagttcgtgcagcggcgcgccgccgaacgcctcctcgaaatcgaccggctcgacgcggcccgcgacgggcgcgagcgggttgttcagcaccatcgacagcagccgctcgccgggcagttcccgcacgaagcgcacgagccgcgcggcctcgtatgcggcatgcaccgagcggtcgaccacgacatggacgagatcggacgcgacgagcgcgtcctcgagcagcttgccggcgccgctcccgacgtcgaacagcacgtagtggaagcggtccttcagcatgtcgaccaggcgcgcgacggcctcgtcgcccaccggggtgtcggcgccatacgccagctcggcggacagcacgtgcagccggtcgcccttcgtgacgaacatgcgctcgaacaacgcgtcgtcggggcgctgccccatgttcagcagttcgatcagcccgttgttgctggacagcccgaacatcgagttcgcgccgccgccatgcaggttcaggtcgacataggccacgcggcggcgcttctcgcccgccaggaagcgcgcgaggctcaccgtgatcgtggtcgcgccgacgccgcgggcgccgacgaagctgacgaccttgccggtacgcgcctggacgaccgattccgtggccgtcagcgcgcgccgcatcaactcgacggtcagcggcttgacgatgtagtcctgcacgccgatgccgagcaggttgcgaaacagcccgacgtcgttctgcgtaccgatcgcgatgacgcgcaccgacgggtcgcacacgtcggcgagccgcatcaggtccgacaccggcagcaccgaatccgacacgtcgatgacgagctggcgcggcgaacgctcgtactgctgcagcagccggatcgcatcgtcgcaggtgcccgcctgcagatgggtgcgcgtgatcgacagctcctgcgcgacgcggcgtatcacgtcctcgctgcccggatcggcgacgaccgcgacgagatcggccgctcccgcggacgcggcgcgccgggtgtgctggcgatcgaggaggttcatgggcggcatcgtgatggcatccgggtcggttcaatggccgggcgagccggtcgtcagcgtcttgccgggcgtcggctgcttcacgcggtcctcgacgtagcggcgcaccgcgtcggccgcggcctgcgcgtccgcgccgccgtacggcacgggcgcgacgagatcctccggccgcgcgagcatcgccgcgaggttcgagtaggtcgcgcagccgaacggcacaccgggccgcgcgtaccccgcgtcgacgagatgcgacggctgcatcagcgtcgcgcaatcgggcggcaccgcgcgcgcgccgtcgaagccgatcgtccgcgcatcgggcaggttgaccggcggcggcgccgacaggcagcccgcgagccccagcggcagcagtgcggcaacgatcgatcgggttcgcatgggcgcgcctccggttcagtacacgaagcccgcggcgccgacgaggcgcggcgtatcgcccgacagcaggtcgagccccaggttgcgctgcaccgcgaactccaggtcgctgctcggccgcgcgaccgtgtcgatcgcctgctcgagctggccgggcccggccggctgcacgatgtacggcgtgacgatgacgaccacctcggtcttgttgtcctggaagttcttcgacgaaaacagccggccgatgatcggcagccggccgagccccgggatctgcgacacggtgtcggccgtctggctctgcaggaggccgccgatcgcgaagctctgcccgctcgacagctcgaccgtcgtctcgacgcgccgcaccgtgagccccggcaccttgacgccgccggtcgtcacgctgttgttcgcatcgacctcgctcacttccggccgcaccttcaggctgatccggttgtcggcgagcacggtcggcgtgaaatcgagcgacacgccgaacggcttgaactcgaccgtgatcgcgccggtcgacgagccggcctgcgcaaccgggatcggaatctcgccgcccgcgaggaagctcgcggtctcgccggacatcgcggtgaggttcggttcggcgagcatcgtgatcaggccctcctggtcgagtgcgtcgagcaccacgtcgatcgaccagcgtcccgcgcggaacccgccgagcaccgagaacgcgcccgtcggcgacaggttgaacaggctggtcgtcggatcgaacagcgtgcgcccgttgaacagcccgccgacgaagttgccggccccgcccagcgagctccagttgatgccgagctgctgcgtgatgttgcggctcacctccgtcacccgcacgcgcaggttcacctggatcgggcgcgacagcgtgagccggttgacgatcttttccttgtcgtgcaggtacggcgtgagcgactgcatcacggcgtcggcgtcggccgcgctcggcaccttgcccgacaccatcagcgagcccggtgcaccggataccgacagcttcagttgcgggaagcggctgtcgagcacgccctgcagcgatgccgtgtcgacctgcacgatcaccgtcttgcgcaggatcggacgatggttcgcgccgagcgcgatcagcgtggtcgtccccgccttcttgccgaacacgaatacggtacgcggcgacggcacctggatgtccgcgatggccggatcggcgacgaacatcgcggttgcgggctcgggcagcgacagcagttccccttgccggtcgcgatcgacagcgccgcgcccgcgtccggcgcccgcgcgacctgcgcggcggcgccccggacgcgatgccgcaggccaggcccaggaaagcgatccaacgaaccatgcgcaccatgcgtgttcccgtcaaatgccggccgccggacggacggcccgaatcgtcaatccgtcactgcaccgtcgctcccggcggcggcgcacccgcctgcgccgcgacattggcaccgcccggtgccgcgggcatcgccggccacgacggcagcccggacggcagcggcggcaggcccggcgtgccggttccgccgccgtgcgatccgtcgtcgatcgacgaaccgcgatagatcacgacggcgttgttccgccacgccggccgcgcgcccgcatccgtcccggcggacggctcgcgtgcggtctcgcgcgccgcgcgcgacacgtcgccggcccataccggctgggtatcggcctcctgctcgtcgccgcccgccggctgccgccggtcgctcgtcgcgaagctgcgcagcgcgagcgaaagcgagccgaggcgggtcgccaccagcacgacctgcgcggtgcgcggcgcgacctcgagcgtgaccgtgcgcgcacgcgccgtcgcgtccggcgcgctcgcgggcgccttcgcgcgctggaattcggaaccgaccgcgagcacgcgcgcgccgcaccaccgtctccgcttcgaacgtgcccggcgacgtcgccgagccgccgatctgctgcgtcagcaacacgtcgacgaagtcgcccggctggatcagccccgcgttgcccgacacgtcgtcgaccggcaccgagatcgcgcgcatgccgggttgcagcgcggccgcgagaaaatccggcgcgccggccggaatcacgttctcgacgcgaatcggcgcgcccgcgcccacgtggttgcgcagcagcgcgcccttcaggtccgcgcccggctgcgactcgacgaacgcgccggccggcacctgcgcgcgcggcatgcgtttccacgcgagatcgttgtcgcgcagcagcagcccttccggcaggtcggcggcggcgacccgcacgcgcgcctgatccgtttcggcgggcaccgacggcgtcgacgcggcgacgtagagttcgcgcaggatgaacgcaccgatgccggcggcaacgacgagcacggccattctcagcggtttgggcatggcggcgtgcgtccccgggctaggtaagcgaaaccgtgtgtggaaacgacgcccagacggccagcgtgccgccgagcgcgagcgccacgccgtacggcacgccgcgcgcgtcgatcgcgtgcaccggcgtggcgcgccgcgaccgcgataccagcaacgcgacaccgcacagggcaccgcccgcgccgacactcgccagcaccggaaacaccagtgccgggccggcccacaggcataccgccgccgccagcttgacgtcgccgccgccgatccagcccgcgtgacgcatcgcgccgaacagcaccagcgccgccgcgccgatcgcgacatgcccggccagcggcgcgaagccgtcgcgcgcgagcgccgccgcgacgaaatacagcgccgcgaacgcgagcaccacgcgattggacagccgccggtcgcgcagatcctgcgcggcgagcgaagccagcaagaccgtggccaccgactgcacgagcgtgagcatgggagagccgtccgtcgacacgcaccggccgcggatacgttctaccgctgcggattccggtgttcgtcggtggcgcgcgggttcagcggatcagatcaggctcgtcaccttgttgatcagcgtcgtgaatatgctcggcaagccgccggtgttgctgctgaggatcacgccgaccgccgccagcgcgaccacgacgatgccggccagcactgcgtattcgagcgagctgacgccgcgttcgtcacgcagcagggacttgacgtattgcagcatggcaacctccgtgtaacgggtcggtgaccgaccgttgaacgcaaagacgcacccttgctccggcggttgcgcaggaccttcgcccattgcgatgcctgcgggcgaccctggcactgggtcgttcgcatccccggaatactctcgatcgcgacaacacgcggcgcgcaacgatgacttcgaccgttgcatgcccgcatccatggtgcggtcttcccgcacgatgcaaccacgctgattcgtctagggtatagacaatttttcaggcgaattcaaatgatttggcgtcggagtgcatttatggatttcatgctgcaacgatgaatgccatatcgctcatttgccttcatttttctcgcggcatttcgcatggttcacgtatcggaacaggcattgccactgttgcggcgcatgattttccggccggccgccgaaccgtttccattcgatttatcggcatgccggattgatcgacagcggctcgcttctccttatccggcctgacttcccggcaaaattgaccggcccgcatcgcatttccccgattaccggcctccgtctttccgcccggattcgtccagcgacccttacgcgaatccatccacgtcgtcattgcgattttcaaatcgacgattgcccgattcggcatccggccgcaatcgacatgatgggaatcctgaatgaatctccaatgcatgtgaatgcggttctccgccacaaagaacggaacgcgcggcgcggcatcccgcaaggcggcgataagcatagttcaaatcgtttcttgtccggccccggcacgtcatcgagaatgccccgacgggctgcggcccggccttgttcctcaacgttccggacccgtcgattcatgcttccactgcgcctgctgcgatcgctgttcattgcgtccctcattgcgttgccggccgccgccgcgcacgccgacaagcccgccaccatccgcatcggcgtcgcccagcaaggcgccggcgatccgccgacgttcggcggctcgagcgccgccaccgcgcagttgcagcaacaggtcgaaaaggagttcgcggcagacggcatcaaggtggaatggctgttcttcaagggcgcggggcctgccgtcaacgaggcgatcgccaacaaggcgctcgacttcgcgtaccagggcgacctgcccgccgtgctcgcgcgtgcgaacggaatcaagacgcgcctgctgctcgccgcgagcgtgcgctcgggcgtcaagatcgcggtgccgcccgactccacgatccgctcgatcaaggacctgaaggaccgccgcgtgtcgatcttccgcggcaccaacctgcagctcgtcgccgacaatgcactcgcgaaaaacggcctcggcgaacgcgacctgcgcgtgatcaacctcgatgccgcgagctcgctcgccgcgctcgcgtcgaaaggcatcgacgcgtcggtgggcgactaccagctgtacaagctgcgcgacgcggggctcgcgaagatcatctacgaatcgcagaacgacggcccgcagttcacgcgccagacgcacctgctcgtgctcgacgatttcgaccgcgcgcatccggacatcgtgcagcgtgtcgtcaccgcgatcgtgaagagcgcgcaatggtcgtccgacgaggcgaaccgcgacgcgctgttcaagctgtgggcgaagagcggcgtgccggtttcgtcgtggcaggccgactacgcgaaccagcgcctgaaggaccggttgtcgccgctgatcgatccgttcttcgtcgcccgctacaagtccgtcgcgcaggatgcgctcgcattgaaactgattcgccagccggtcgacgtcgacggctggttcgagccgaagtatctcgacaacgcgctgcgcacgctgaagctcgaaaactactggcaacgatacgacgcggccggcaagcccctttcctgacccggactaccccgatgagcgacaccgcgttttccgtcccgtcatccgacactcgcccgcccgccgcgctcgccgcgcagccgcacccggcggcgcacgtgaaacggtggtcgtggcggctcgcgccgtggctgctgcccgcgctgctgttcgcgctgtggagcgtcggcagcgcgcgcggctggatcgcgccgcagatcctgccgccgccggaacgcgtgttcgacgcgctcgcggatctcgcgacgagcggcgatctcgtgcgccacacgctgatcagcctgcagcgcgtgctggtcgggttcgccgccggcacgctgctcggcttcgcaaccggcgtcgcgctcggcctgtcgcgcacgctggaagcctacgtgctgccgagcttcaacgcgctcgtgcagattccggtgctcggctggctgccgttcctgctgctgctcgtcggcgtgggcgaaccgctcaagtacctgctgatcgcgcatgcggcgctcgttcccgtcacgctgagcacgctgcaaggatttcgccagaccccgcccgcgctcgacgaagtcgcccgcgtattcggctacacgcgccgccagcgcatcgtgcacgtcgtgctgcccgccgcgatcccgacgctcgcgaccggcgtgcgcctcgcgttcacgaagtcgtggctcgcgctcgtcgtcgtggagctcgtcgcgtcgtccgaagggctcggctacctgatcgtgtacgggcggcaactgttccagctcgatctcgtgatggccgccgtgatcgtcgtcggggcggtcggcctgctgatcaaccggctgctcgacgcgctcgaggcgcgcctgcgccgcggcgtgccgtccgccttccggggctgagccacacacgatgcccgtcccgcccgcgcaaccgaaggagattctcccgtgacgcattccgcttcgccggacgccgcaccgccggccgccacggccgcccgccgcctgcgtgcgcccgactggcgcggcttcgtcctgccgctcgtcgcgctcgcgctgtggtgggccatcgcgtccgcgcacctcgtgaacagcgggctgctcgtcggcccggccgacgtgctgcgcaccgcatgggcgcaagccacgagcggcgcgctcggccgcgcgctgtccgcgtcgcttgcgcgcgaagcctgcggtttcgcgatcggcgcggccggcgggctgctgctcggcaccgcgctcgggctgtcgcgcatcgccgcgcggatggtcggcccgagcttcgacacgttcaagcagatctcgctgttcgcgtggattccgctgatttccgtatggttcggcctcggcgacgtcgccaaggtcgtgttcctgtcgctcgccgcgctgctgcccgttgccgcgcacacctgcgacggcattcatgcggtgccgcgcgcgtatgtcgacgtcgcccgcgcgctgcgctactcgcggctccagctcgtgcgccacgtgatcctgccggccgcgctgccgtcgatcttcaccgggctgtatctcggcctgatctattcgtggctcgcgacgctcggcgccgaatacctgctggtcgccggcagcgggatcggcaacacgctgatcgacggcagcgaacagttccggatggatctcgtgctgttcgggatcatcgtcgtcggcgtgaccggctgggccctgaacgcgatcgcacgcgcgatcgagcgcaaggtgctggcccggcgcggcgacctgccgcgctgatcgccccttcctttccccttcctcacaccgccatgacgaccctcgcctccgattcgctcgacatcctccacgtgagcaagcactacgcacaacgcggcgccgcgctcgccgtgctcgacgacgtgtcgctgcacgtgcgcgccggcgagttcgtcacgatcgtcggcgcaagcggctgcggcaagtcgacgctgctgcgcctgatcgccgggctcgacaccgactacgcgggcgagatccgtgccggcgccgagcgcgtacgcgacacgtcgctgcaacgcgggatcgtgttccaggatcaccggctgttcccgtggctgaccgtcgcgcagaacatcgaggccgcgctgcgcaacgcgccgctcgacgcggccgcgaagcgccgcgcggtcgccgatcacgtcgcgctcgtcgggctgaacggcttcgagcatgcgtatccgaaccagttgtcgggcgggatggcgcagcgcgtcgcgatcgcacgcggcctcgtgaaccgcccgcgcgtgctgctgctcgacgagccgttcggcgcgctcgacgcgcagacgcgcgcgcggatgcagaacgagctgctgcgcatctgggaacaggagcgcatcacgatgatcctcgtcacgcacgacgtcgacgaagccgtgtatctcggcgaccgtgtcgtgacgatggcgccgcgcccgggccgcatcgagcgcatcgtcgacgtcgcgctgccgcgcccgcgccggcgcgattcaccggaattcgcgcggctgcgcgacaccgtgctcgccggtttcgacgacggcgaaccgccgggcgacgatcacccgcgcggcaagcgtatcgacccgccgcgcccgcaccggatcggcgaatggcggcttgcgtggtagcacgcatggcgcttcgatttgctcagcacgacgacgcatatcgatcatcgccgcgcgcacgctaaggttgtgacgattcatcggttccggttgcgcacggtccctgcttgaatggagactcgaccgacccgactccaggagactcccgatgtccgaagtccagcacgccgctcacccgtcttcgcatgcttcgcacgccgcgccgcgcacggccgccaccccgctccagcttcgccaggtcgccggccggatcggcgccgagatcgccggcgtgcggctgtcgggcacgctcgacgacgcgacgttcgacgcgatccaggccgcgctgctgcgccacaaggtgctgttcttccgtggccagcaccacctcgacgacaccgcgcaggaagcgttcgcacgccgcttcggcgagaccgtcgcccacccgaccgtgccgtccgtcgacggcagcgcacacctgctcgaactcgattccgcacacggcgcacgcgccaattcgtggcacaccgacgtgacgttcgtcgatgcgtacccgaaggtctcgatcctgcgcgcggtcgtgattccgccgttcggcggcgataccgtggggccaacacggccgccgcctacgcgaacctgcccgacccgctgcgcgcgctcgccgacacgctgtgggcgctgcatacgaacgcgtacgactacgcgtcgacgcacgtgcacgccgacgctgcgcaactgaagcgctaccgcgaagtgttcacgtcgaccgtctacgaaaccgagcacccggtcgtgcgcgtccatccggaaaccggcgaacgcacgctcgtgctcgggcatttcgtgcagcggctcaaggggctgtcggcgcaggattccgcgcacctgctgcaggtattccacgagcatgtgacgcgtctcgagaacaccgtgcgctggaactggcaggaaggcgacgtcgcgatctgggacaaccgcgcgacgcagcactacgcgatcaacgactacggcgatgcgcgccgtgtcgtgcgccgcgcgaccgtgcacggcgacgtgccggtcggcatcgacggccgccggagcgtcgtgctgaaggggccgggcgcgacgctgcaataacgcccgcgtcacgcggcggcgccgttccgtgcgcgccgccgcacctgccctccgccaccggacacccgaccatgcccttcccgccaccggaccgacgcacgcacgcgcaacgatgtcggccccgcaccctgttcacttccgccaggagcgtcgcatgagcgccttactcgaacccgccgccgagccgatcgacgtgatcccgctgtccgcccatatcggcgcggaaatacgcggcgtcgacctcacgcaaccgttgaccacgccgcagatctcggcgattcgcgccgcgctgctgaaatggcgcgtcatcttcttccgcgagcagttcctcacgcacgagcagcacgtggcgttctccgcgcagttcggcgagccgacggtcggccacccggtgttcgggcacgtcaacgggcatcccgccgtgtattcgatcgcgaaacaccgcaaggccacccgtttcgaaggcgaaccggtgcgccggccgtggaccggctggcacaccgacgtgacggccgcggtgaacccgccgtgggcgtcgatcctgcgcggcgtgacgatcccgccttacggcggcgacacgcactggaccaacctcgtgcgcgcgtacgaaacgctgtccgcgccgctgcgcggcttcgtcgacggcctgcgcggcattcatcgcttcacgccgccggccggcgcgcgcgcaaccgatgcgttcgacgacgcggtcgaacgccgcccgctcgtgaccgagcatccgctcgtgcgcgtgcacccggagaccggcgaacgcgcgctgtacgcgagcccgagcttcctgaaatcgatcgtcgggctgacgccgcgcgagagccaggccctgctcgaactgctgtgggagcacgtgacgcggcctgaattcacgatccgcttcaagtgggagccgcgcagcatcgcgttctgggacaaccgcgcgaccgcccacctcgcgccggtcgacatcttcgatctcgacttcgaccgccagctctatcgcacgacgctcaccggcgacgtgccggtcggccccgacggccggccgtcggttgcgctcgaaggctcgccggtcgaggccgcggcggcggtcgcgctcaactgaaccggcggcagccggcgcaccgcggcgcgccggcctttccgtcacttccgtcacgtcacgccgatgaatgcgcgggccgcgcgtgcgcgcggcccgtccgtcaatccagccagaccccgtcgaagcggtgcccgccgagcggcgagaacgtcagcccgtgcacgcgcttggacacgggcagcgacacgatcgacgtcgcgatcggcgtgaacggcacctggtcctgaacacgacctgcgcctgttcgtacagcgccgtgcgtttcgcgacgtccgcattggaacgcgcggcgtccaccagccgttcgaaatcctggttgcaccatttcgcgagattgctgccgtgcaccgcgtcgcaaccgagcagcgtgccgagccagttgtcgggatcgccgttgtcgcccgaccagccgtacaggatcgcgtcgtgctgcccttcgagcttcgcgcggcggttgtattcgccccattcgtagctgacgatcttcgcgcgcacgccgatcttcgcccagtcctgctggatcaactgcgccatcagctgcgcattcgggttgtacgggcgctgcacgggcatcgcccacagcgtgaggtcgaagccgttcgggaaaccggcctgcgcgagcagcgccttcgcggccgccggatcgcgcggcgcatccttcaggcgcgggttgtacgaccattgcgcgggcggcatcgggttcgtcgcgatcttcgcgtcgccgttgaacacggtcttcacgatcgccgacttgtcgatcgcgatgtcgagcgcgcgccgcacgtcgacacgatcgagcggcgcatgctgcgtgttgtacgcgacgaagccgacgttgaaacccattcccgagaacaacgacagcttcgggtcgcgccgcaccgtgtcgaggtcggccggccgcgggaacaccgatacctggcattcgccggacaccagcttctgcaggcgcgcggccggatcgggcgtgatcgcgaacacgaggcgggcgagcttcacgtcgtccggcttccagtagtccggattcgcgtcgtagcggatcagcgcgtccttctggtacgtgcgcagcaggaacggccccgtgccgaccgggaactggttgatgtcggcctcgcgatgacgcgccgcgagctgcgacgcgtactcggccgacaggatcgacgcgaacgccatcgcgagattgcgcacgaacacgacgtcgggcgtcttcagcacgaagcgcaccgtgtagtcgtcgaccttgtcgatgcgttcgatgttgcggtcgaaaccgaggtcgctgaaatacgggaagctgaccggataggccttgcggaacggatcgtcccgatcgagcatccggcggaaggtgaacacgacatcgtcggcctggaacggccgcgtcggcttgaaccacgcgttcgtctggaacttcacgccgcgccgcaaatggaacgtgatcgtgcgctggtcgggcgacacgtcccagctcgtcgcgagcgacggttcgagatcgagcgtgccgcgcttgaactgcacgagcccgttgtagatcgtgaacgtgctcgcgtcgaaatcggtgctcgtcgtgtgctggcccgggtcgaagccggccgggctgccttcggtgcaatacacgagcgtcttgccggcgggcgcggccagcgcctgcgtggccgcgccggcgagcagcagcgacgccgcgatgcagcacagggccgtcgcggcgcgcggcggtttccgcacgcgaggcgcggcgggcgaaacgaaagaggtcttcatggtggcggaatcggtggctgtcatgcaaatgacgacggccgatcttcgcgcgtcgtccgccgatcgcttaccaattaattgcgcgttgcttatcgctggatcggcatcccgccgccgcggcacggggatgtccgtgcgagcgtcgggcacgtggcgcgcgtggtctcttccggccccgtgcaggttcgccgaaatgggcgcatcgtatcggctggccaacgccggcgcgcatcccgtcgcgccgccgattccaggaggacacaccatgcctgtcagccccgatacgcctgctcgcccggtgaagacgccgggccccgatcacccgatcacgatcgaatcgcacccgcggcgggtcgtggtcaagtcggccggccggatcgtcgccgacacgcgccgcgcgctggcgctgcgcgaagccgcctacccggccgtgctctacatcccgcgcgaggacgccgacctgacgctgctgctgcgcaccgatcacgcgacctactgcccgtacaagggcgactgcgcgtactactcgatcccggtcggcggcgaacgctcggtcaatgccgtctggacctacgaggcaccctatccggccgtcgactcgatccgcgggcacctcgcgttctatccggatcgcgtcgattcgatcgaggaaagcccgaccggctccgattgagcgtcgcggcagcgattcaggcagcggctcgtcgcgcgccgggcggccacgcgtgcgaggcggcgatttctccggggcggcctgccatgccgccccgttccggccgcgttttggctcgtcgctgcgggtttttgcaccgatcgccggatcgaacgccggcaacgcatccaccgctgatttgcatatgcgcattcgttggttggccgccaacgcaggcggacgtatcgtcacgagtccggcgcgggccggcccgtggcgtgcagcgcccgcatccggccccgccctgcgccgaccgcgtcgcctttcgcgcgcggcccgctccttcgcccgcaggacgcttcgatgaacacaccgcacgcagacgttgaaccgacaccggcgaacccgcagcgccgccagtggctgcaaggcgcggccgccgggctggccgggctcgcgctcggcccgctggccggccggcccgcgcacgcgcaagacagcggcacgcggctgcgcgtcggcttccagaaatacggcaacttcgtcgtgctcaaggcacgcggcacgctggaaaagcggctcgcgagccagggcgtcacggtgcaatggctcgaatttccggccggcccgcaattgctcgagggcctgaacgccggcgcgatcgacgtcggcacggtcggcgagacgccaccgatcttcgcgcaggcgggcggcgtcgatttcgtctacatcggcaacgagccgcccgcgccgcagggcgaggcaatcgtagtgctgcccgattcgccgatccgcaacgtcgcgcagctgcgcggcaagaaggtggcgttcaacaaaggttcgaacgtccactacctgctcgtgaaggcgctcgaacacgcgggcctgacgtatgccgacatccagccgatctacctgacgcccgccgacgcgcgcgccgcgttcgtgcaacgcaacgtcgatgcgtgggtgatctgggatccgtacctggccgccgcagagcggcagatcggcgcgcgcgtgatcgcgaacggcgaagggctcgtgcgcaatacgcagtactacctcgccgcacgaaaatacgcggccgctcatccgcaggtgctgcgcgcgctgctcgacgaagtcgacgcggtcgaccgctgggcacgcgaccatgtggcggaagtcgccgcacaactgtcgccgctcgtcggcctcgacgcgccgacgctcgaagtcgcgctcaagcgcgccggttatggcgtgcagccgatcagcgacgcgacgctcgcgtatcagcagaacatcgccgacgcgttcagcgcgctgaagctgattcccggcaagctgtcggtggccagcgcacgctgatgcactgccgccgacgcacggcgcggcacacgtgcgtcagcgcgcggggccgcgccgatgcgccgccattcgtcgtagtcggtgacgaggcccgcttcgtcgaccgcgatatcggccgcatacgtgccgctttcatagcggtacacgtgctccgccgtgcgggtataacgctgctcgccgcgcacgaactcgaaatcgggaagcgcagccacgcggtatggatcacggccgcctcgccgacggccagcccgagccgccggatcggcaacgtgttcgtcgacgggctgaaaccgaggtcgatatcggtcgcgcccgcgagcgccggtacgtcgacgccgtcgatcgtccagcgccctgcgtcgcacgcgatatcccgctgccgtggcggctgcgtgccgccccactgcgtgatgcgcgccgcgcgcgtgagccagtcggcgccgcacgagaccgcgtaatcgacacgaaacggcgcgccgtcgatcgcgcccgacaccgaccccgacaagccgatacccgttcgcgactcgacgagcctgcaccattcggccgcctgccaggtctgcacgatctgccatgcgacgcagcgcgtgcgcaccgcttcatcctgtcgcgtcatgtcatcgtctccagtcgatcgcacggaagccgattgtcgcccatcgcaccggcgaacacacgcggcttgcgcaaccgatggtcagtatcgggtcgctccacaccttcagtcagccgtgctttggtaccatccgtcgatcggcatcaaccggaaccggacaaggggcgcaacttcatggatttgctggcgacgatgcgcatctacgtcagggtcgtcgagcgcggcacgatgtccggcgcggcgcgcgatctcgacatgggccagccggccgtcagcgagcgcatcgaacggctcgagaagcatctcggcacacggctcctgatgcgcagtgcgcgcaccctcgtgtgcacggaagaaggccggatcttctacgaccgcagcaaggcgctgctcgaagcggccgacgatgcggtcgcatcggtctcgaagacggaaaccgcgctcgacggcacgatccggctcgcggcgccgcaatgcttcggcgaggtcgtgctgccgggcgtgctgatgcatgtccgcaccgcgtatccgggcctgcacatcgatctggtcctgaacgacgacatcgtcgatccggtcacggaaggcgtcgacatctcgatccgagtcggacagctcggcgacggcgggttcgtcgcgcacccggtcggcacggtgggccgccggctcgtcgccgcgccgtcgtatctcgaccggtgcggcccgatcgacacggcggccgatctggccaaccatccgttcatccgcgtgaaaggcgtcttcgcgagcgaacggctgcccgtgcagcacgacggcggcccgctcgaatacgcgcgcatccgcacgatcatgacgacgagccactggcggccgatgttcgacacgatcgcggcgggcggcggcatcggcgtggtccagcacccggcctgcgccgacgcgctcgcggccggcacgctcgtcgagctcctgccgcgctacgcgattcccgacttcgcgctcaacgtgctcgtccacgcgcagcggccgctgccgccgcgcgtgcgggccgtcgtcgatctgctgaagcaggacatcccgccgctgctggcccgccctgcccgctgacgacggcagccgccgtcaagcctgccgcgacttcccggttccttcacgtgagcgtctaacatgacgcattgctcgtcacgccgcgggccggatgcgggctcgcggccgttgcgctcgcatgcgcacgcggcacggcacggcccgctcggcaggcggcgcgcgcatcgcgacgtgaatgcatggcgggcggcgcgacgcgcacgcccgccccgtcaccacgcctgccggtaaatctccagcgcatcggcctccgtcacctcgcgcggattgttcacgagcaagcgcgtctgcagcatcgcgtccgacgccatcctcggcaggtctgccccgccgataccgacctcgcgcagcgtgcgcggaatgcccgtcgcggcgatcagccggtcgatctcgccgatcagcgcgtgcgtacgcgcttcgtcgctgcccgtcgccgacggcgcgacgatcgccgcgagttccgcatacagcggtgcggcggccggtgcgttgaaacgcagcacgtgcggcagcacgagcgcattcgacagcccgtgcggcacatggaagatcccgccgaccggataggccagcgcatgcacggccgcgaccggcgcattcgcgaacgcctgccccgcgaacatcgcgccgaccagcatcgcctcgcgcgcgtggcggtcgtggccgtcgtcgcacgccgcgagcaggttgcgcgacagcagcgtcagcgcgtgcacggccagcatgtcggacaccgggttcttcagccgcgcggacgtgtaggcctcgatcgcatgcaccatcgcgtcgatgcccgtcgcggccgtcgccgcgcgcggcaggccgagcgtcagttcggcgtcgaggatcgcgacatccgcgaacaggtgcggcgacacgacgcccatcttgcgcgcctcgccgaccgtgacgatcgacacggccgtcacttcggagcccgtgccggccgtcgtcggcatctgcacgagcggcagccgcgcgctcgtgaccttgtcgacgccgtacatgtcggccagcgcctgctgcccgggcacgagcaccgcgatcagcttcgcgacgtccatcgacgatccgccgcccaggccgagcacgatctccgcatcggccgcgacggcccgctcggtcgcgtcgaggaccacctgctcgggcggatcggcgatcacgtcgtcgatcacggtgacctgccagccgtgcgcggcgaggctctccagcgccggcgcgagcacgccgctgcgatgcaggaacgcatcggtgacgacgcacagccgcacgagcgccggaaagcgttcacgcaacaacgcgccgagccggcgcgcggcgccgaattcgacgacctgcgtcggcacggtgcggaattgaaacgggttcatcaggcacctcccggcgacgtcgccgtgccggtgtccggctgcaccatgaagcgcaacacgtcgcggcgatcgagcaacgggaagatcgcgccgacaccgatccgctggaaatgcggcgtatcccgatgcacgtcgaggccgtccgcatagcggtagcgttcgaggatcacgatgtggtcggggttctccgccgaccggaaatacgcgtagtcgaggttctgcggctcggtgcgcgtcgccggcgcgagttccgcgagcagttcgatcacgcggtcgccgttgcccggtttggcgaagaaatgcgcgatgacctgaaggtagggttcgttcatgttgcgctccgtgttcgactgggggccgtcacgacggggacgcacacgatgcgcggcgaatcggggattcgaacgcgacggcgcaacgccgtgtcactggcttgtcgtcgcattgtattgaatccgcacggtcttcgcagagccggcatcgggccgcaaaaagcccggcgaaacccgtgccccgttcacggcacggcggatcgcaacgggccgccacccgcgcgctgcatcgccgcaacgattaccacggcaccgtccgccccagatagtcgagatactcgagccccgggcgcgcccgcttggcgaccagcacgtcgacgaggctcggcacgctttcctcgatcgtcaggcgcgcatccgggccgcccagctccgtgcggacccagccgggtgccatcagcaccatcgcacgccgcgtatcggcctggcgcgccgcgaagctgcgcatgaactggttcagcgcggccttgctgccgcgatagacctcgcgcatcccgctgacgttgttcgcgacgctgccctgccccgacgacatcgcaccgatcaggccgtccgcggtcacgcgatcctgcaacgtctcgatcacgcgcatcggcgccagcgcattcgtgaccatcacgcgcacgaactcgtcggtcgtcacttcgccgatcgtttcggtcggctcgttcgtcgttcccgcattcacgaacagcatgtcgaagcgccggcccgacagccgctcgcgcagcgcggccagtgcgccggctcgcagatgtcgagcgtctcgatgtcgagccggccgtcgaaccggtcggcgaggtcgtgcaggcgcgtgcgccccgatccttccgcacggtgcccgtgacgctccagcccttgctcaggaattgctccgccatcgcgagcccgaggccgcgcgaggccgcgacgagcaggatcgtcggtgcgtttttactcgatacagtcgattgcatggtgtccgcctttgccgggttgcgtcatgcagccactataggtgcgcgtccagacaggcgacagacgcacccgactcaaaccatagttgcatctaacgccatgtcacatcgtgccgtggcgtatcctgtcgccatggaagacatcgacctgaacctcgtcaccgcgctcgacgtgctgctgtcggaaggcagcgtgaccggcgccgcgcgccggctcggcctgagcacgtccgcgatgagccgcacgctcacgcggctgcgggtgtccaccggcgatcagctgctcgtgcgcgccggacgcaagctcgtgccgacgccgcacgcagccgcgttgcgcgaccgcgtgcacgcgatcgcgaccgatgcgcgcgcggtgctgcggccggcgacggccgacgtggatctggcgacgcacgcgtccacgttcaccatccgcgcggccgcatcgttcatggaaatgctgtccggcccggtggtcgccgcactcggcgaaatcgcgccgcaggtgcgcgtccgcttcgtcccgaaacccgaccgcgatccgcaagcgctgcgcgacggcgccgtcgatctggaaatcggcaaacgcggcgacgatgccccgaactgcacacacgcatgctgttccacgactggcacgtcgcggtggcacgcgccgggcatccgctgttcgcatcgggcaggatcacgcccgcgcgttatgcggcctgccgtcacgtgatcgcgtcgcagctcggcgatttcggcgggccggccgacgacccgaccgacggggccggccagggcgacgccgtgcgcgtcgtcgtaccgggctacccggatgcgatgcgtgtcgcggccagcaccgacctgatcgcgctcgtgccgcgctcgagcctcggcaacgcattctcgccggggctcacggacgccctcgggctgcgcagcttcgagatcccggtgcgcttgcccgggatcctcgtttccgcgctgtggcatccgcgcatgcacggcgacccgtgcatcgccgcctgcgcgatgcggtcatcgccgtctgccagcgcgcgtatccggatacccgcacaccgcacacatcacgcccgccggcgcgcgccggcccgcgcgccgcaggctgacacgcggctcagaccagccggccgccgccgtcgatgtgcaggatctcgccgttcatgaagccgttgcccagcaggaacgcgatcgcctccccacttcatcggcgcgcccgacccggccgccgggcaaagccgacgccgcacccgcgagaatcgtgtcgcgcgcttccgcgccgaacgcgtcgtacagcggcgtctcgacgaagccgggcgcgacgacgttcacgcgaatcggcttcagttccagcgcgagcgactgcgccagcgcctcgacgccgcgcacggcggcggctatgacggacgtgccgtgcgcggccggacgatccgacagttgcccgccggtcagcacgatcgagccggtcgccggcatcagcggcaacgcggcccggatcgcgtagaccggcccggcgatacgttcctgcagcgcggcgagcagcgatcgggatcggtctcgttcagcttgcccgcaatgaaccggccggccgtgacgaccaggtgatcgacgcgcgtgagcgagtcgaatacggcctgcaccgcctgccggtccgcgatgtcggccactgcgatgcgcgcgccgccgatcgcttgcgcggcggcctcgagcttcgcgcgggtccggccgaccaacgtgacgctcgcgcctttcgccttcgcggcggccgcggcctcgaggccgattccggagcttccgccgaataccacgacgtgcgcaccgtccagtgccgaagattgcgttgcctcgttcatgtcgactcctcgtcatggattgaaggttcgcgaacgttaggtcattctccattgcgcaggaacgtgggagacttgaataaggttcattccccgaaggaataagatggaatcgctgcgatccatgcgcgtgttcgtccgcgccatcgagctcggcaatttctcggcggtcgcgcgcgaggaaggcaccggccagccgacgatcagcaagatcgtcgccgcgttcgaaaaggaactgggcgtccgcctgctcgaacgctcgaccacgagcctcgcgcccaccgacgaaggccgccggttctacgatcgctgcaagcgcgtgatcgacgaatacgcgagcgcggtggccgaggtgcgcgggcaaacggtgcggccggtcggcaagctggtcgtcaatgcgccgatggggctgggcgagctgaggctgaatgcgctcgtgctcgaattcctcgccgcatggccggagatcgaggtcgagctgcaattgaccgaccgtgtgatcgacctggtcgaagaaggcgtcgacgtcgccatccgcctcggccatctgctgccgccggatgccgtggcgcgccccatcgcgtcgtcgccccgcctgctggtcgccacgccgaagtacgtcacgcaggcaccgaggctccgccggccggaagacctggcgcggcacgagtacgtcggctacgcacgcgcggacatcggcaacgaactggcattcgcccgcggcgacgagcaggtcgccgttccggtgcgcggccggtatcgcgtgaacagctcgatggcgctgcgggaatgctttctcgccgggaacgcggtgggcagcgggccggcgtggctggttcaggacctgatcgacagcgggcagctcgtccggttgctgccgaagtgggacatggtgccgccgcatgcgctgcacctcgtgtatgcgtcgcgccggtatctgccgctcaggacccgcacgttcctgcagttcatggagcagcggattcccgggctgccggggttccatccgacgaccgccgcgaccgccaacccggccgcgcgcgcatcgcggcagccccgctgaccggcgggcgtcgcggtcacggccgcccgggcgccgatccgccaccgttttcccgatccgccgaattcccgctattgcagcgcccccggcggcggcggcaggccgttcggctaaaatgccgcactttccaccttgtccggcccgctcgccatgcaacccgcctcctccgcccaacccgccacccatggcgccgacgccgcagatgcggcccgcgacctcgtctacggcccgaacgaccggccggcgccgatggtcgccttcgtcgcagcgctgcagcacctgctggcgatcatcgtgccgatcgtcacgcccggcctgctgatctgccaggcgctcggcgtgtccagccgcgatacgaccctcatcgtgtcgatgtcgctggtgatttccggcatcgccaccttcgtccagtgcaagcgcttcggcccgctgggcgccggcctgctgatcgtccagggcacgagtttcaacttcgtcggcccgctgatcgccggcggcagcctgatggtcaagcaaggcacgccggtcgaaaccgtgatggccgcgatcttcggcgtcgtgattgccgggtcgttcgtcgaaatgggcgtgtcgcgcatcctgccgttcgtgaagcgcctgatcacgccgctcgtcaccggcatcgtcgtgctgctgattggcctcacgctgatcaaggtcggcctcatcagcatgggcgggggcttcggcgcgatggccaacggcaccttcgcgagcgcggagaacctgacgctctcgggcctcgtgctcggcacgatcatcctgctgaaccgcgtgccgatcgtgtgggtgcgcagcaccgcgctggtcatcgcgctcgtcatcggttatctcgcggccgcgttcctcggccgcctcgacttcaccggcatgcaccaggccgcgctgttccaggtcccgacgccgctgcacttcggcatcggcttctcgtggtcgctgttcgtgccaatgctgatcatctacctcgtcacgtcgctcgaagcgatcggcgacgtcacggccaccagcaagatctcgaacgagccggtcgaaggcccggtgtggatgcagcggatcaagggcggcgtgctcgtcaacggcgcgaactcgctgctggccggtgtgttcaacacgttcccgagctcggtgttcgcgcagaacaatggcgtgatccagatcaccggcgtcgccagccgccacgtcggcatatggatcgcggggatgctcgtggtgctcggcctgttcccggtcgtcgccggcgtgctgcaggccgtgccggaacccgtgctcggcggcgcggcgatggtgatgttcggcgcggtggccgcatcgggcatcaacatcctcgcgggcgtccagctcgatcgccgcgcgctgctgatcatcgcggtgtcgctcgcgctcggcctcggcgtgtcgcaggtgccggacatcctcaacagcctgccgcacgcactgaagaacgtgctggaatcgggcgtggcgacgggcggcatctgcgcgctcgtgatgaactggttcctgccggaaaagtaagcggatgatccgcacgatgcgcggtgcgcctgacgggccgcaccgcgcgtcgtgccggccggcgcccgcggctcgttgcgggcaacgcgatcggcgtatcgccaaccggccgattccgctcgcgccacccgttgccccgattccacgcggcgccgcgtcacacctggaaccgcccgtccgctatcgccggcatcaccggttcccgtacaaacgcggcatcggacaattgcagcagcgtacgcacgacagccaccacgtcgtgaaccgtcaccagcccgccatcgcaagggcgtccggcgcggcacaggccacacgtcacaagccacgagacgcgcacgccgaactgcgctttcgacatgcaccggggttatcgaccccgtgtcggcggcgatcaaaggtcaaacccggtcatgccgccttggccgatcgatttgtgctggttagaatcacgacatgccccgagttcccgcccccaacaacaccccgagacgcccgccgtccccgtcaaggaacgcgcgaccgtcgtctgctaccgcggtgaacgcgtcctgctcgtcgcccgcgcggcgtcgcgctgggcccttcccggcggcacgatcaagcgcggggaatcgccgctcgaagccgcgcatcgcgagttgtccgaagaaaccggcataaccggccagacgctcgtctattcgatgcagttcaccgggctcgcaaagatccatcacgtgttcttcgcggaagtcggcccggaccagacgccgcaagcgaacaacgagatcgagaaatgcaagtggtttccgatcgacggcgtcgacggattgcgcgcaagcattccgacgaagcgaatcgtcgaactcgtccatcaacacgaaatccgcaaggcgtagcgcgcgacggacgagcgcatgccccggcctgcggccggctcgagtcgctgttcgtgaacccgcgacgcgcgaccgctcagtgcatgcgcttcctgcgcaattcgcgcgtggaatagacgacgaggaagatgcccagcatcgcggcaccggacgccatgaagtcgtttgcgctacccgaaccgtgcagggacgtcgggaatatgccgagactcaatcctgcggccgcgagaagcaatcctgcaaccacgccccagatcggcccggcggtcttgtcgatgttatttttcatgcagcacccgtctacagtcattacctgaacggtatcggcaaagcacgccgcgtctaccttcagtgattccactatagcccggaaaaaatcattgaagctttagtgcttctaccgatcaagttttatcgatcgcggccgcccgggcgggccgatcggcaatccggctcggccgagccgacgccggccaccgaagaacgcatatgccgcacgcccatatgcattccacgatcgcttgttttaccgcgcaacgtcgcggcgctaagctcggaacccgccgtcgacttcccaatggcttcccgccttcgcccaccatgccgaactccgccgaacaggccgccgactggctgctctccggactcgaactgcgcagcacgctgtttcacgtgggccggtattgcggcgtctatcgcgcatcgacggccggccatcagcgcgcgagcttccacctcgtgctcgaaggcgcatgctggttgcacctgcccgcccggaacggccgtgccgcgcaaagcacgcgcctcgtcgccggcgacgcggtgttcctgatgcacgacatgacgcattgcctgacgcccgacgcggttgcgccgtccgacgacgaatacacggtacggatcggcacgatgacaccgcttgccgagcctgcgtcgtcccgggcgacgtcgcgctggcatgcggtttcttcgagtttcgttccgatcttggcgacgcgatcgccggcctgctgcccgaccacctcctggcgcgtcacgacgacgcgaagctggcgggcgcgcgcacgctgttcgacctgatccgcaccgaagcggcgcgtgcccaggatgcaccgtcgccgctcgtcaatcgtctgacggatgcgctgttcttctatgcattgcgtgccgtcgcgagcagcgacgattttgcgccgggcctgtggtcggtcatgcggcgcgccgaatttacgccgctcgtcggcgcgatcatcgagaaacccggcgacgactggaccacgcacacgatggccgcgttttgccacatgtctcgcgcgcgcttctgcaagcagttcgcgcaggcatgcggacagccgcctgcgcagttccttgcgctgctgcgcatgaaggtcgcggccgagatgctgcggcaggggcatccacgctcagcacggccgagcatgtcggctatcagtcggaatccgcctttgcgcaggcattcaagcgcgtcaccgggctgccgcccggcacctgccgccgcgccccggagcgcaccggcgcgacacccgtgcattgacgcaagacaaacgcgcatgaaacagagacggccgcgcattgccggctcgaccggcgccgccaacaatgacggctttccgatcgaggatgccatgagccgcctgcccctccaaaccgtcgaaagcgcgcccgaagccagccgcccgtttctccagaagtcgcaagccgccaacggcttcctgccgaatctcgtagcctcactcgccaatgcaccggttgcgctcgaaacgtacctgaccgtcggtgaaatcaattcacgcagcggcctcacgctggccgagcgcgaaatcgtgcagatcaccgccgccgccgttcatggctgcggtttctgcgtggccggccatacggccgtcgcgctgaagaaggcgcaattgcccgccgcgctcgtcgacgaggtccgcgcccagcgcccgctgtccgacgcgcgcctcgatgcggtcgccacgttcacgcgcgacgtgatcgcgacgcgcggcgccgtgtccgacgaagcgctcgccgcgttcaaggcggccggctacagcgatgccggcgcgcttgaagtggtactcggcgtgagcctcgcgacgctttgcaacttcgcgaacaacctggcgcgcaacgaactgaatccgcagctcgaagcgtatcgctgggagccgacggcgcgcgcagcatgaccgcgccggcgagctccgacgcgttcgacgcatggctcgaagcaaatgccgacgcgctcgacgtcgacccgtcgcgggcggcggacatccttccgcagctggtgcgctcgcgcaccgtcgccgtcggtgtgccggaggcaatgggcggcacgggcggcacgatcgcggacgcgatcgacacggtggccgccgtcgcgcaacgctcattgacggccgcattcgtgctgtggggacatcgcaccttcatcgaatacgtactgcagagcgacaacgacgcgctccgtgcgcgctggctgacgccgctgctcgacggcgaagtggcgggcgccaccggtctttcgaacgcgatgaagtatctgtccgacatcgagccgctgcagatgcatgcggcccgcagcggcaacgcgttcgtgctgaacggcagcctgccgtggatcacgaacctgcggcgcgaaggcttcatcgccgcggccgcattcgatcacgacgacggcacgccgccgtccgtcttcgcgattccgcacgacgcgcgaggcgtcgagcgcagcgacgatctcgacctgatcggcctgcgcgcaagcaatacggctgcgctgcgcgtgagcgataccgtcctcgacgaatcgtaccgcctcgcggccgacgcaccggcctggctcgcgcgcgtgcgcccggcgtttctcggcttgcaatgcgggatgtcgatcgggctggcgcggcgcgcgttgctcgccacgctggatgccagcgagccgtcgcgcgcgtcaatcggcgcggaaattcgcgaactcgaaacgacgctcgccgatcaggccgcccagttgaagcgcggtgtgctcgacggcacctttctccacgcgcccgcgacgatgttcgaactgcgcatcgcgctcgtcgagaccgtctcgcaggcggtctcgctcgaagtgcaagcgaccggagggcgcggctatctgcgcggccagagcggcagcgcgcggcgcgtacgcgaagcgtcgttcatcccgatcgtgacgccgagcctcgtgcagttgaaatcgcagctcgcgcggcatcgacgggcggcggcagcatgacgcaaggcgcgcacatcgtcgcgaacggcgtcacgttgcggtacggatcgcgcagcgtgctgaacggcgtcgacctgtcggttgcgcccggcgaactcgttgcgctgctcgggccgagcggttgcgggaagtcgtcgctgttgcgggccatcgccggcctgacgcgaaccgcatccggcacgattcgcgtcgatggcgagcccgtcgacggcccgcgcccggaggtcgccctcgcgtttcaggacccgtgcctgctgccgtggctcacggtcgagcggaacgtggggttcgggctgaccttcgcgcgtcaaccgcacctgacacgtgcagaccgcaaggaacgcgtgacgaacgcattggccgccgtcgggctcgaccatgcacggcacgcgctgccgtcgcagttgtcgggcggcatggcacagcgcgcggcgctggcgcgctgcctggcacgggcgccgcgcgcgctgctgctcgacgaaccgttcggcgcgctcgacgaagtgacccgcgccgacatgcagcagctcctgattgccgcggtgcgcaacaccggcgcgtctgcgcttctcgtcacgcacgatatcgacgaagcgctgctcgtcgccgatcggatcgtgctgctcggcaagcacggcacgctggtcggacgctggaccgtcgaactgccgcagccgcggcacgcaagtgcgctcgctcggcgagctgcgcatctccattctccaggcgctgcagaactcgatttcagcagccgcctgaatccggccgataccagcggggaatcctcatgtgcaacgtaccgatgtcacgacgcgaatggctgaagctcgcgtcgctctttaccgtcgcgggcgcggcgccgctgctgaaagcatccggcgcgcgcgcggcagccgatccgaatgcgcccgtgcgcatcggctacctgccgatcaccgatgcggcgccgctgctcgtcgcacacaacaacggctacttcgatgcggccggcatccaggcggagaagccgacgctgctgcgaagctgggcgcagctggtcgaggcctttctgtcgggacaggtcaacgtcgtgcatctgctgtcgccgatgaccgtgtgggcgcgctatggcagcaaggcgcccgcgaaggtcgtcgcatggaatcacgtgaacggctctgcgctgacggttgcgcccgacatcaacaccgtggcggacctcgctggcaagacggttgcggtgccgttctggtattcggtgcataacgtcgtgctgcaggacctgctgcgtgcgcagggtctcgcgcccgtgctcaagcagtcggggcagccggggccgaaggaagtcaacctggtcgtgatggcgccgtccgacatgccgcccgcgctggcgtcgaaaaagatcgcgggatatatcgtcgccgagccgttcaatgcggccgccgagcagttgaacgtcggcaagattctccgcttcaccggcgacgtgtggcgcaaccacgcgtgctgcgtgatcttcatgcacgagcaggacctgacgcaacgcgcggcgtggtcgcagaaagtcgtcgatgcgatcgtcaatgcccagctgtggacgcgcgcccatccgcaagaggcggccaggctgctgtcgaaggaaggcccgaaccgctacacgccgcatccttcgcaactgctcgcacgcgtgctcgcgccgcaagcagccgatcagggcgctatctcggcgatcgcgcgatccagcacgcgagctggggcgtgaagcgcatcgacttccagccgtatccgtatccgagctatacggaagaactcgtgcgccggttgaaaacgacccaggtggaaggcgcgagccagttcctcgcgtcgctcgatccgaaacgggtcgccggcgatctggtcgacgaccggttcgtgaagaagagcatcgaagcgctgggtggcttgtcggcgttcggccaggatggcggttatacacgcaaggagacgatcgttgtctagcgtgctcgttcgggaaacgtcgtcggcggcgcggcgtccggtgcccgcgtccgcgcattggcgcagcatcgggctgggcggtgcgggactggcggccgccctggtgctgtggtggctcgccgtcacgctgctcgcgggccacaacgcgatggccgcgcagttcgcgccgcagcgtgcgttcgaagcgctgccgtcgctcgtcaccgaggatcagctgctcgtgcatgcggcgaccagcctcaggcgcatcgccgtcgggctggcgtgggcgctcgtggtcggcgtgccgttgggattcgcgatcggccgtctgcgctggctcgaacggacgctgtcgccgacgctgcagtttcttcgcatgatctcgccgctttcgtggatgccgcttgcggtgatgtcgctcggcgtcggcgatcgcgcggtgtatttcctgctcgctttcgccgcggtctggccgctggtgatgagcaccgcgtcgggtgtcgcgcatctcgaccggcgctgggtccagcttggcgaaagccttgccgccacgcgcgcggaaatgctctggcatgtctacgtgccgggcatcgccgcgcatgtgctcaccggcgtgcgcctcgcgatcggcatcttgtggatcgtgctggtcccggcggaaatgctcggcgtgagcgcggggctcggctacctgattctcgacacgcgcgaccggctcgcgtattcggagctgacggccgtgatcctcgtgatcggcgtgctcggtttcctgctcgatctggccgcgcgcgcggtcgcagcccggctgtcgagcgatatgccgggggcgatcggtaggttccggtgagtcggggatgcgttgaatggcggaaggcagcaggagtcgaacctacccgggtgtctgacacccccaactggatttgaagtccagccgtaccaccggatacgaatgccttccgtcgtgggaaaaacaaagaacaacgagcgcctacgcctgaatacccgcccaaccgctgtcaggccgcaggaagtggagatcgcggtggaagcgagatacccaacccggtcgaagaactcgagaatctggatcgcacgcttgcggcccagccccgtcgcgtcgcggaacgtcgcggcatcgagcccgccgtcgcgcgacggcgcgagatgcgcaaccagttccgcgagttcgcgcacgacgtccgcgtgatagaacaggtcgcgcacgacctggtgcacgtcgccgcgccgtgcgagcttgcgcagcaaggtacgcaccgcgtcctcggccgcccccgtgtcgcgggccaggtcgcgcacccacggcggatcgaagcgccccgcatgaatcagcggcagcagttgctgcgccagcgcttcctcgcgcggatcgaggctcaccgaatgcgacggcaggtgcagccacggcccgcttcgggccacttcgccgccggtcaccagcgcatcgacgagcgcgcgccacagcgcatcgccggcgagcggcgccgccatccgccgcagccgcgcggcatcgagcccctgctcgtcgggcatgcgctcgtgatacgcgcgcagcgtatcgattgcccgcgtctgcagcgcacgccagtgcgcatgggcaatcaccgcgccgtcattcgacgcggcatcgcgctgcccgattgccagcgcgtcatccggcaaaaccagcgcgttcggcgcaaaacccgtcagatgcgtgagcatcgcgcgcgggacgccgagcggcgcctgcgcgagcagcgcatcgagacgccctgcgtcgagccattcggccagcgcgtcgagccacgcgcggcgctggggcgtacgacgcttgcgcgccggcccgaacgggtcgagcacgcggccgccgccgaccgtgcgcgtcgcctgcggattgcggacgatgaaccggtcgcccggcaacgcaaacaccggctcgtcgaataccagttgcacgcgcatccgctggccggccgcaagcgtatcgccgtcgagcaacgcgacatgcgcgacgcgatgcagcgtgccgagatgcacgtgcagcggtgcccagtgcgtgagcgtcagccccgcatccgcgagcagcgtcagttcgacgtcgagacgcggcgacgtcgcgacgagccgcgcatcggccacggtatcgccgcgctcgacatcggccttgtcgaccccggccaggttcagtgcacaacgctcgcccgcgcggccggactcgaccggccggttctgcgcatggatgctgcgcacgcgcgccgcgccgcccgtgcgcacgatcacgagcgtatcgccggtcgcgacgcggcccgcgaacgcggtgcccgtcacgacggtgccctgccccgtgagcgtaaacacacgatcgaccgcgagccggaacagcccgtcgtcgcggcgggcgcgccacgcgatcgccgcgtcggccaggtgacgcttcaatgcggcaacacccggatcgtccacggccgtcgcccgcgtttcgaagatcggtacgccggccagcgtcgaatcgttcagccatgcggcgatctcgtcgcgcacctcggccacgcgcgcggtgtcgacgcgatcgcacttcgtcagcgcgacggcgccatgcgtgacgccgagcagttgcaggatcgcgagatgctcgcgcgtctgcggcatcacgccgtcgtcggcggcaatcacgagcagcgcgaagtcgatcccgcacgcgccggccgccatcgtgtgaatcagcttctcgtggcccggcacgtcgatcaggccgagcacgtcgccgttgtcgagcggcgtatacgcataaccgagttcgatcgagatgccgcgcgccttctcttccttcaggcggtcggtatcgacgcccgtcagcgcgcgcaccagcgtcgtcttgccgtggtcgatgtgtccggcggtaccgacgatcatgcagcgggccccgcgagcggtacgcattgcgcgatgaacgccgcctcgtcggccgcttcgaggcagcgcaggtcgagccgcagcgcgttgtcggccacgcggccgatcaccgggcgcggccattcgcgcagccgcttctcgagctgcgcgagcgcgcggccgccgcgcttgccgtccgccgtgcgcacgacgagcccggcgctcggcagctggtcgaccggcagcgcaccgctgccgatctggctgaacatcggctcgaccgctacgtcgaaaccgccgccgagcgcggcctgcagcgccggacgcacgcgttcggcggcctcggcgatctcgccgtgcgggcgcgtcagcaggcgcagcgtcgtgagccggtcgcgcaggaactcggggactggtagaggcgcagcacgggttcgagcgccgcgagcgtcagcttgccgacgcgcagcgcgcgcttgagcggatgtttcttgatcttcgcgatcagcgcacgatcgccgacgatcaggccggcctgcggcccgccagcagcttgtcgccgctgaacgtgacaacgtttgcgccggcggccacggtttcctgcacggtcgtctcgtgcggcaagccccattgcgtcaggtcggcgagcgtgccgctaccgagatcgacggcgaccggcagcccatgctcgcgcgcgagcggcgcgagttcggcgagcgacgtctccttcgtgaagccgctgatcgcgtagttgctgcagtgcaccttcatcagcagcgcggtgcgcgggccgatcgcctccgcgtagtcgcgcagatgggtgcggttggtcgtgccgacttcgcgcagcctggcgcccgcgcggctcatgatgtcggggatgcggaatgcgccgccgatctcgaccagctcgccgcgcgacacgacgacttcctgcttcgtcgccagcgccgacagcgccagcagcacggccgccgcgttgttgttgacgacggtcgcggcttccgcgcccgtcagttcgcacagcagatcgtcgatcaggtcgtcgcgatcgccgcggcggcccgtggcgaggtcgaattcgaggttgacggggcgcgtaagcgcgtcgaccaccgcgcgcaccgcgtcgtcgggcaacagcgcgcgcccgaggttcgtgtgcagcacggtgccggtcaggttgaacacggtgcgcaccgcgccgcgctctgcgcggccagcgcgcgcgcgacggccgcggcgatgcgcggttcgtcgagcggttcggcccccgccggatcgtgctgcgcggcggtacgccagcgttcgagctccgcgcgcacggcgttcagcacgcgcgtgcggccgtagtcggcgagcagcggttgcagcggcgccgacgacagcacgcgctcgaccgacggcacacgcgccagcacggcattcagttcattcaaaccgggttcggtcacgtcgtggtggctccagtctcatgcttcgcagtcggccggcgccggcgctctcgcgccgccccggccgatgtcgtcaatccgcttcccgcgcgacatccggccacagcagcgggttcggcgaactgcgctggtaaccggcctcgttcatcagcaggtcgagcgtgaggctcgcgagatcgtccgccagcggctcgaactcgtagtccttgtcctgataaccgatcttgcgataggtcttgcactcgtcgcacgattcggccttgacggcttcgctgccgccctcgatcccgtgatacgcgatgcctttcgtcgaatcgcagtgcgagcacttcgtgcgcaccatgtgccactcggtcgtgcacagcccgcactgcaggaaacggtagccctggtactgcccgccgacccgcacgacgctcgcgaccgggtgcgtgccgcacacggggcagccccggctggtcgagatacgggacgtcggccggcgcaacgcagcttgcgagatccgtccagacgacctgcagcgcggccatcaggaacggcgcggtggccgggtcgacttcggcgaagcgcagcgcgaggatcgcgtcggcctgcgcgtcgagttcggcgggcgccatcaggcgcagccggtcgagcagcttcgcgagctgcgggttgacgagtccggcgccttcgacgcggtcgagcagttcgtacagcacagcccgccattgcgggttgcgctcgccgtcgagcgccggtatgagcggcatcgaatgctgctgcgcgagcgcgatcgcttccttcgacggcagcggcagttccagcgtctgcagcgtcgcatgctgcgcatcggcgacggtggccatcagccgcaggtagccgctgatcgggttcaggtcggccagcttgcgcagccgcgcggcgcgcgccgaaaacgcggtggcgcgctccggcaggcgaaagcgcgggatggccgaatgatcgagtgtcgagatctcggtcggttcgaggatgcgttgtgtcacaaaaatgtcttccaaataaacaagcgccgacgcatcggcgctttcgggcggctccggcgaaggaacggaacgcctcgccgtgaccggcgagccgccccgctccggtgcgttatttcacgctttcacggaaccacttcgggtgatgcttgcgagcccagcccagcgtgacggtgccgcgcaccatcgcgccgatcgagcccttcacccacaacgccgcgtaaatgtgcacgatgatgctcgcgatcagcacgaaggccgccacggcatgcacgacagcggccgcgcggatcaccccgatcgggaagtagaacgagaagtaacgccgccagatcacgactcccgacagcaggagcagcaacaggcacgccaccagcgtgaagaatagcagcttctgcccggcgttatagcgcccgacgggcggcagcttgtcttcctggttggtcagcacgtcgccgatctgcttcagccattggcgatcgtccgcatcgagcgcgttgtggtgccagaagcgcacgaccaggatcgcgaacgacacgaacatcacgaggccgacgaacggatgcaggatccgcgtccactggccgccgccgaacagcgcggtcagccagaacatcgacggatgaaacagcgcgagcccggacagcgcgagcagcacgaacgtgatcgcggtgatccagtggttcgtgcgctcgttcggcgtgtagcggacgatcaggttggggtcgtcgtggttcatttcgcgtcctccttgatgcgtcgcgcctcgtcgcgcgcggccgattcttcctcgtcgctcacctcgttcggaccgacccggacatagtggaagaacccggcgagcgcggtcagcgcgatgccggccaccgcgagcggtttcgcaatgcccttccacagcttcaccatcgggctgatcgacgggttgtcgggcagcccgtggtacagcgacggtttatcggcatgatgcagcacgtacatcacgtgcgtgccgccgacgccctgcgggtcgtacagccccgcatgctcgaagccgcgctccttcaggtcctcgatccgctcggccgcgtgctgcttcatgtcctccttggtgccgaacacgatcgcgcccgtcgggcaggtcttcacgcaggccggttcctggccgaccgcgacgcgatcggaacagagcgtgcacttgtacgcgcgatgatccttcttcgagatccgcggaacgttgaacgggcagccggtcacgcaatagccgcaaccgatgcagttctcctcgtggaaatcgacgatcccgttgttgtactgcacgatcgcgcccggcgacgggcacgccttcaggcagcccgggtcctcgcagtgcatgcagccgtccttgcggatcagccactcgaggtcgcccgccgggttctcgtattcggcgaaccgcatcaccgtccacgagtgctcggagaggtcggccgggttgtcgtacacgccgacgttggtgccgacttcgtcgcgcaggtcgttccactccatgcacgccgtctggcatgccttgcagccgatgcacttcgatacgtcgatcagcttcgcgacgctcccggtcaccggttcgcgcaccgtgggcggtggcgtcgtggtggccgagacgcgcttgatatccagcgattgcaatgccatctctttccccttacgccttttcgaccttcaccaggaacgacttgaattccggtgtataggagttgccgtcacccacggacggagtcagggtattcgcgagatagccgggcttcgtcagacccttgaagccccagtgcaacgggacaccgaccgtctggaccttcttgccgtcgaccatcagcggcttgatccgcttcgtgacgagggcgaccgcgatgatgtagccgcgcttggacgacaccttcacgcgctcgccatgcgcgacgccgacttccttcgcgaggtcttcgccgatctcgacgaattgctcgggctggatgatcgcgttcagccgcgcatgcttggtccagtagtggaaatgctcggtcagccggtacgtggtcgccgcgtgcgggaactccggtgcctggccgaaggacgcccgatcgtccgggaacacgcgggcggccgggttgttcagcgccagcgggttgttcgggtgcagcgggttcgtgccgatcggcgtttcgaacggctcgtagtgctcgggaacgggccttcgttcatccccgcacgcgcgaagaagcgcgcgacaccttccggattcatgatgaacggccccatcccgttttcgggtggttcgtccgccttgaaatcggggatgtcggcacccttccacgcgctgccgttccagccgatcagcttgcgggtcgggtcgaacggcttgccgctcacgtcgcacgatgcgcggttgtacaggatccgccggttcgccggccaggcccacgcccagttcagcgtctggccgatgccggtcggatcggagttgtcgcgccggcccatctggttgccggcctgcgtccaggctccgcagaagatccagcagccgctcgcggtcgtcccgtcgtccttcagttgcgcgaacgcggccagctgctcgcccttcttcacgagcgtcttggccggatccttcggatcgggcagatcggcgagcgcacggccgttgaactccatcgcgagctcttcgggcgtcgggctttccgggttcgcgtacggccaggtcaggttgacgatcgggtccggatacttgccgccgtccgtctggtacatcttgcgcatgcgcaggaacagccccgacatgatctcgaggtcgctacgcgcttcgcccggcggctccgcgcccttccagtgccattgcagcacgcggctcgaactcacgagcgaaccgttttcctccgcaaaacacgtggtgggcagacggaacacctcggtctggatcttcgacgcgtcgacgtcgttgtagtcgccgtgatgcttccagaactcggacgtctcggtcgcgagcggatccatgatcacgagccacttcagcttcgcgagccctgccgccgtcttcaccttcgacggcgccgccgcgagcgggttgaagccctggcagatgtagccgttcatcttgccggcattcatcagctcgatcgcctgcagcaggtcgtactgcttgtccagcttcggcaggtagtcgtaggcccagttgttctcggcggtcgccgcgtcgccccaccaggacttcatgaagctgacgtggaaggccttgtagttcttccagtagctcaactggttcggccgcagcggctgctgcacgcgcttcttgatgtagccgtcgaaatcctgctcggcctgcatcggcagcgtcatgtagcccggcagcaggttcgacatcagcccgaggtcggtcagcccctggatgttcgagtggccgcgcagcgcgttcatccgccgccggcgatgccgatattgccgagcagcagctgcaccatcgcgccggtgcggatgatctgcgcgccgatcgagtggtgcgtccagccgagcgcgtacagcaccgtgccggcgcggccgggaacggcggtggtcgcgagcatctcacacaccttcaggaacttctccttcggcgtgccgcagacctgctggaccatgtcctgcgtatagcgcgcgtaatgctgcttcagcaggttgtacacgcaacgcgggtgctgcagcgtcgggtcgaccttcacgaagccgtcgtcgccacgctcgtagtcccagctcgatttgtccgggtatgcgtgtttctcggcgtcgtagccggaatagatgccgtcgttgaacgcgaaatcctcgcgcacgatgaacgagaagtccgtgtagttcttcacgtactcatgctggatcttgtcgttcgtcagcagatagttgatcacaccgcccaggaagacgatgtcggtgccggtgcggatcggcgcgtagtagtcggccaccgaggccgtacgcgtaaagcgcgggtcgacgacgatcagccgcgccttgcggtgcgccttcgcctccgttacccacttgaaaccgcacggatgggcctcggctgcattgccgcccatcacgagaatcacgtccgcgttcttgatgtcgacccaatggttcgtcatcgctccacggccaaacgtcggggcaagacctgccaccgtcgggccatgtcagacacgcgcctgattgtcgaatgcgagcatcccgagactgcggaccgtcttgtgcgtcaggtagccgacctcgttgctgcccgccgacgcggccagcatgccggtcgtcagccagcggttgaccttcgcaccgtcctctgccgtttcgacgaagttcgcgtcgcggtcggccttcatcagcttcgcgatccggtcgagcgcgtcgttccacgagatcggttcccacttgtccgagccgggcgcgcgatactcggggtgcgtcaggcggttcgggctgtggatgaagtcgatcaggctcgcgcccttcgggcacagcgtgccgcgattgacgggatggtcgggatcgccttcgatgtggatgatgctcggctgcgcgttcttcgcgccgtctccgaggctgtacatcaggatgccgcaacccactgaacagtatggacaggtgttgcgcgtttcgacggtgcgcgccagcttgtactgtcggacttcggcgagcgcttcggacggagagaagcccatcagggctagactcgatccggcaagcgacgtagccgtcaccttcaggaactggcgccgggacatttggagcatggctggtctcggcgttattgtggggtgaggaaactgaaaggaattatagacagttcgcgcaactatgttcgaatcttcggatcaatactgaattgtctgattaccaacgatgacccgcgttccgcgcgccaccgaaccgtcatgaaacgacagatcacctccgaagccacccgtctcgcgcaacaacaggccaactgggccctcacggcgttcaagcgcttctcggccgaccgttgctccgcgatggccgcgggcattgcattcttctccgcgttctcgctcgcgccgatgctcgtgatggtgattgccgtggccggctggttctacggcgacgacgccgcgcgcggccaggtattcgaacaggcgcaccagctgatcggcgacgacgcggcggccagcatccagacgatcgtgcagaacgcgcaccgcgcgggcgagcgcggcggcctcgcaaccctgatctcgttcgccgcgctggccatcggcgcgtcggccaccttcgcgtcgctcagcgccgcgctcagcgtgatctggccggccaccgagaaccgctggtcgagcatgctcgggctcgtgcgcgtgcggctgatctcgttcgggctcgtgctcggcgtcgcgttcctgctgatcgtgtcgctcgtgctcgacaccgcgatcacgttcgtcggcacctggctgctgggcaattcgccgtacgtggtcgtcacgaacctcgtgcagttcttcgtcggcatcgccgtgctcgcggccgcgttcgcatcgctgatgaagttcctgcccgatgcgcgcgtcgcgtggcgcgacgccgcgatcggcggcatcgtgtccgcgatcctgttctcgggcggcaagaaactgttcgcgctgtacctcgcacacgcgggcaccgccagtgcattcggcgcggccggatcgttcgcggtcctgctgatgtggctgtacttctccgcgatcgtgctgctgctcggcgcggaattcgcggcggcccgcggcaacgcgcatcgtctcgccggtaccgcaccggccgcgtccgctcaagccgaccggcccgtcgatcgcatgcgcgacgactgattcacgctgttcgcaacgtcgcggcgcaccccagcacacccgtctgccttcctgcaaccaccccagtccgccgcgcattcgcgcgacgttgatacgtcctttgcatgccccggcttcgttgccgcaaccgcaaacgtttgcaagcatccatttccgtccgccaacgggccaaaacaggctgccggccgcaatgcgcgtcgacttttgaaacaatcgcgccgcagcaaatgtcaactatttcaaaaatgggaacagtcgttgatgtgcttgatatatatggactttttcgcgctgttaccttttcgagacactttatttttaggctttcttgcgtctatggcactgagctattctccaatccgcaacaaataacgatgaatcacttgcgtggagaaactcaacgatgaagaaacttgctctctcgaccctctcgctcgcgctgctgggcgccgccggcgctgctcaggcacagtcgagcgtgacgctgtacggcgtgatcgacacgtcgatcacctatgttcacggtaacgacggtcaaggtaacaattcgtggtcgatgggtagcggcaacctgcaaggcagccgtttcggcctgaagggttccgaggacctcggtggcggcctgaaggcgatcttccagttggaaaacggcttcaactcggcatcgggcgcactgggccagggtggccgcatgttcggccgccaggcattcgtcggcctgcaaagcgaccagtacggtacggtcacgctgggccgccagtatgacccgctcgtcgacctggtccaggcagtcacggcagacaactacttcggcagcgtgttcgccacgccgggcgacgtcgacaacaacgacaacagcctgcgcgtcagcaacgcgatcaagtacacgtcgccggtctgggcaggcctgcaggtcgaagcgatgtacgcactcggcggcgtcgcaggcgcaaccggcaagggtcagacttgggcggcagctgcagcctacaacaacggcccgctcggcctggctgccggctacttccacgcaaacaactcggctccgctgagcgcagttggccagcgcaccggctgggccggcacgtcggacgagatcttcgacagcccgggcagcagcttcatcaacaacgcatacacgtcggcttcgtccatcggcatcgcgcaagtcgctggccagtatgcattcggcccggtgacgttcggcctcggctacagcaacgcgcagtacaaggcggatgcgaactcggccttcggcacgaaccagaagtacaacacgggtcgcgcattcgtcacgtaccaggcatcggcaccgctgctgctgggcctcggctacatctacacgaagggtagcggccagacggacgccaagtaccaccaggtttcgctcggcgctgactactcgctgtcgaagcgtacggacatctacctggttggcgcgtaccagcacgcaagcggcaagaacgcggacggtaccgatgcgcaagcgtcggtcggctcgtacggcatcgccggcaagagctcgcaggaaatcgtcgcactcggcctgcgtcacaagttctaaaaacgaagtatccggcgtgcatggcgtctccgacgccctgccgccgacctggaaagccagccccggtttcggccgcggctggctttttcgtccgtcgccggctggcccgcacggcctgcacgggccgatggccgatgtccgggtacccgacactcgtcacccggccggcagcggcgcctgacggccgcaatgcgccggaaacgcggtttcctgatgccaggctcgctcgccacgggtgcgccggacgactaccatccgcactgtcggtgccacggccccggagcgacggccgttcgccccggcgtgtcgatttcgacggccttcatccgtcgtacagaggccggcacgcgatttgcgccccggccaatccatacagacaggagattcgccatgacgattcagaagatcacgcctttcctctggtattcgacggaagccgaagaagcagcggccttctacgcaggcatctttcggattcgcgcatcgtgcgcgtcacggcggtgcccggcaccgacggcacgcgaatggtcgagttcgagctgttcgggcagccgttcttcgcgatgagccacccgcgcaccgacacgttcaaccacgcgatctcgctgctggtcagctgtgccgaccaggcggaactcgaccgctactggaacgccctgctcgacaacggcggcacggccgacgcctgcggctggctgcgagaccgctacggcgtctcgtggcagatcgttccggaagcgctgatcccgatgatgtccgaccgcgacaccgtcaaggccacgcgcgtggccgccgcgatgatgcagatggtcaagctcgacgacgccgcgctgaaggccgcctttgccggtacggccggctgacgatgcacatcgcataagcgcgtgcgaatgatgcgccgggtcgccggacaggcgtccggctcgactgcaaacgcgtgcgacagcgtcgcaaacgcccgtgaccctcgtcggccccgtccgcaagccggctacgttcgcggcatcggctgcgacgtcgacagcatcgattcgaccgttcgccgcgcgtagccgatgaatgcggcgagggttcgcccgacaggatcgccgtgtcttcctcgccgccgagataggcggcgcgcgccgccgctacaaccggacggtacgtttccggcagacgctccagcgcccatgtcgcggcgacgtccttgggcgcgatcctgccggtcgcggcgctgtaccagatgcgcgcgagcgcgagcaccacgttgcactcatcgccgcgccaactcggttcggcatgccagtgcgcgacggtcgccagcaacgcggccacgaaatccccctcaggcaccggctcgagcaacgcagcagccggcgggccggccagcgcgacactgtgctgccgcaccttcgtcaacaggatcgccagatcgtgatcgacgagcgccggctcgacgatgccggcttcgagatcgtgacgcagccactcgccgaactgcagttcgcgccgcgccggatgacgccacggcacgatttcgtcgtgcgcgacgacggtcacttccagtgcgcgcatgccgcctgcgcggccgggcggcgccgacacggcgagcaagccgagcatcagcgcacgccgcgtcggctcgtcgggccgggccgacaccgtcgccagcaggtcgatgtcgctgcgcggtttcagtccgccgtcgagcgccgagccgaacaggtggatcgcgctcagcgtcgcgccgagatgccgctcgatcgtgtcgcatgcggcggcgacctgcgccgcgatttcgtcgggaatggtttcagtcacgatgcgcgtgtctcgcgatgcgtgcgcaacaggcgcaaccggcgcggcgagcgcgagcccctgagtggattgccgttcgtcatggcgtatgcacgacacgtcgtccggcgtgcatcacgcgtcgaaccggactttccgccatttcgcttctgcgcttctgcacttcttcgcggccgcgcgctttgcgcagcgcaataaaatccccgcacgctttcgcgtacggggatcgtcggacttcgcaacggctgccgaatgcattcggtagccgccgcgcggcattacgctgccgcgtccttcagcttcttcagcgcacgtgccttcacgcgcacgctggccggcttcgccgggaaccaacgctcttcgcccgtgaacggatccttgccgaagcgcttcttcttcgccggcacgacttgtgccgtgatcttcagcagacccggcagcgtgaactcgcccgcgcccttcttgtggaccgagccgagcacgacgttctcgagtgcgacgagcactgccttgaccgccttcacttcgacagctgcgcgctcagcgatgtgcgttgcgagcgatgccttcgtgaacttgtccttcagcggcgtcggagcggccggtgccgccttcgcgacgaccttctttgccactactttcttcgcgggcgcagcctttttggcagccactttcttggtggcgggtgcggcagccttcttggccacctttttgcggaagtcgccatgtttctcctaccaggtgtggtcgttggatacacgaagcgtgcaacgcgcgcgcttcaacgccggattctacaagcgccgtgacgcttcgtggagtacttttgtgcgttttcgcggggtttcccgcaggtttttgcatgcgggcgatttcgtcgacgctccagcatcagaaaacgccttcacgtatgcatccgaacgcgaattacgttcgatatttgcgcacctatactgggcgcgctcaatgcccggatgcctccatgcgcgaagcccgatacgtcaaaggactcgacggcctgcgagccctcgccgtcatcctcgttttcctgtcccacaaaggccacgtccttgccgtcgacgtcggcaagcttggcgtgtggacgtttttcctcatcagcggattcctgatcgtcggcgagctgcatcgcaatcgccaggcggtcgaatgcggcaccatgacgcgccgccatgcgctcgcgctgttcctcgcgaagcgcgcgctgcggatctttcccgtctattacctgctgctcgccgcgctcgcgatcgcgcacgcgctgttctaccagcgcggcgtcaatctcgggctcgcgtggcacgcggtgttcctgtcgaattactggatcggcgtcgtgaaggacggctggccgggctccacgtcgcacttctggagcctcgcggttgaacagcagttctatctgctcgcgccgctcgcgctgctcgcggtgccggccgcgcgacacgtcgcgctcggcatcgcggccgtcgctgtgcgcgctcgcgcatctcgcgctctacctgtgcgacgcgtcgccggtgctgatctacgcattttcccgtggaatttcgcgctgatcgcgctcggcggcgtcggcgcgatggcgcttgccggacgcggcgcggccgccgtgcgccgcgtgccgcccggctggctcggcgcggcaggcgtcgtgttcttcctcgtgctgcccgcatgcacggcactcccgacgcgatcgcggggctcgcggatctcggcctgtccgcgtcgctcggcgccctgctgctgtggatcgtcagcgaacccgagcatccggtcgtggcgctgctcgactgggcgccgctcgtttatctcggcacgatcagctacggcttctacctgttccacaacctgattccgacacgcttcggcgtgctgcccgcgcacttcgcgcacggggcaataccggaaatcgtccgcgaaacgctgcccgagatgctgcagttcgcgctcgccgtgctgctcgcgcacctgtcctggcgctacctcgaaaagcggctgctcgacttcaagaagccggtcgccgcgatgctggcccggcggttcgtcgcacagccgggcacgtcggcacgttgaacgccgcaccgatgcggatacgatcgaatgggaaaaccgcgattcgggccacacccggaagctgacacccggccagcgtggcgtggcgccccgtcatcgaccggcaccggcagcaccgctgcggcaccgaacatcgacgtgcagcgcgcaatcgaatcgcgacagaggccgcccggtcgcccgccgtggcaccggtttccggcgtgacgcccatgcttgccggggcgcccggctccgcacacggcaacgctcgcacggcaaacccgtcaccgcactcacctcgacggtgcgcaccagaatcacgcatccgctcgcccgtataaaaagccccggcgcgcgagcggccggggccaacaacaaccaccacctgaaacaacggagcgcgaggctgcttaggcgacagcagccagcgcgggcaagcaggtacgcaggtaggcctcgaattcgcggctcacttccggatgctggagcgcgagctcgacggtggccttgagatagccgatcttgctgccgcagtcgaagcgcgtaccgtagtagcgatacgcgagcacctgctcgttcgcgagcagcgactggaccgcgtcggtcagttgcagccgccgccggcgcccggcttgagcttgcgcaggtgatcgaaaatcgtcggcatgaacacgtagcggccgaccacgccgagattcgacggcgcatcctcgggcgcgggcttctcgatgatgcccgacagcttgatgatgtcctcctcccattcgcggccttcgacgacgccgtacgaacggctgtcgtcgcgcgcgatcgtctcgaccccgatcaccgagctgtgatagtggtcgaacacgtcgacgagctgcttcagcaccggctgttcgccgtgcagcaggtcgtcggcgagaatcaccgcgaacggctcgccgtgcaccagcttctccgcgcacagcaccgcgtggccgaggccgagcgcttcggctggcgcacgtagaagcagttgacgtggctcggcttgatgccgcgcacgagttcgagcagcttttccttgccgcgcctcgagctcggcctcgatctcgtacgacttgtcgaagtgatcctcgatcgcgcgcttgctgcgcccggtgacgaagatcatctcggtgataccggcgttgatcgcttcctcgaccgcgtactggatcagcggcttgtcgacgacgggcagcatttcctgggctcgccttcgttgccgggaggaaccgagaccggcaacggggaacacggccttggtgactttcaacatgttcgcatcctgattgcgttgactgcgccgcgtcgaccagcgacccggcgcgattgtgttccgaacggcatatcgagaatcgacggtactgccaattcgactccgctcattatcgatatggactgattgcccaatgattccggaaaaatataatcctttcaacccggtcgatattgccgaaccgagtgccgaggcagaaacaaattaccgattttccagatacaaattcttacgattcgaattcctcgatatagggcacgccgccccgttcgagccccgggcgaatcggttcgttcttcagcgcctcgcggtacgccgacagcacggccatgaccagcagtactgcagcgctcgcgatccaatgcatgtccatcttgccgctccttgcatcaatcaactggagcttcaaactatcagaaaaaatcggtaaataattgacccacctcgcggaaccgctttccgaacgcgataaaaccatgatgtggaataccgatatttcccggtgagattttttattcattgatcgaattcttgcgcattacgattggatgaaacttcccgtcaatccgtcgcaaggaatcgaatcgcatgcaagctttcagcggatcgtctctgaccgcgccgcccgtcgccgatcacaaggaacacgtgatcgacgcgatgcgcggcttcgcggcgctgctcgtcgcctatttccactgccggcaggtcgtctgggtcggcatgcagagcttccatcacgcttacggccatgcgctcaacccgggcgcgatcgccggctacctgaccttccgttcgcgtggggctccgccggcgtgccgatcttcttcgtgatcagcggctactgcattcaccgcaacgcggcgctcaagctcgcggccgatcccgcgtaccggctcgacgcgccgaacttctggatgcgccggttcgcgcgcatctacccggtgctgctcgccgcgctgctgttcacgctcgcgctcgactcggtcagcctgcagatcgagcccgtcagccacaagatccgcgacgtcggcctcgtcgcgttcctcgtgaacctgttctcgctgcagggcgtcgccggctacacgtacgggtcgaacggcgcgctgtggacgctgtcgctcgaagtgcagttctacgcgatctacccgctgctgttcgcgctacgccggcgcatcggcatgccggcggtcgtggccgcggtcgcgctcgtcaacgtcgcgtcggcgtggctgctcgaacggcacgacctgcagttcttcacgtcgtactggctgtcctggacgatcggcgcgtggatcgccgacgtgcgcgcgcagtcgccgcgcgacgcggccgccgtgccgtcgcgtgcgtggtacggcgcggccgccgtgctgctggccgccggctgcggcgcgttccatttcggccagtacggcgcgttccagctctggtcggccggcttcgcgtgcttcctgtaccgcgcgctcgcccgcccgccgcgcacgacgccgccgttgcgcgtgctgagctggttcggcgacttcagctattcgctgtacctgattcacctgccgctgttcgtctgcctcggctcggtgctgttccattccgaactgcagttgtcgatctggccgtcgttcgcgttcatggccgccgcgatcccggtcgcctacctgttctaccggatgttcgaacggcccgcgatgacgtggtcggccagcttcgccgtcccgccccgcccgcgtcgtcgcgccggcgcccgaacgggcggcctgatccggccggcccgggctcccgagcccccgcgcggcacccgccgcgcgggggctttatcgtggcctgagcgcgtcggcacgccgggttgaccggatgggcgggcctccggcgtcgggccgcgccacgacccgcctgggccgtcctcggccggctttcgctgcgcggggtgccctgggcaccgtcttctcgcgttgccttctcgcgttgccttctcgcgttgccttctcgcgttgccttctcgcgttgccttctcgcgttgccttctcgcgtcaccttctcgcgtcaccttctcgcgtcgccctctcacgtcgccctatcccgctgccgtctcgcatcgcccgccccctccagcggcgatcgtgcaagcacgcgcccgccacgctacacaacgacctgctcgccgctcgcccgaccaggcccccgcgcggaaagcaaagcccccacgcagcgcattgccgcgtgagggctcgttcccgggcggctcgcgccggctactgccttttcgccgcggccttcgccgtatccgcgagaatcttctcgacccgctccacgtaggtttcggtgccgaaccggcgcaccgccgtcgcccgcccgctcgcgacgagccgctcgcgcagcgcaccgtcgcgcttcagcgtatccagcgcctcggccagcgcggccgcatcgcccggcgcgcagagcagcccgttgtcgccgtcctcgatgatctcgacgacgccgcccgcgcgggccgcgacgaccggccggcgcgcgagcatcctcgacgatcacgcgcccgaacggctccggcgtgatcgacgtgtgcgcgacgacgtcgaccgccgtcatgcatgcggccacgtcgcgctggaaaccgaggaaatgcacgcgctcatccatcccgtgctgcgcgacgtattcgtgcagttgcgccgcatagtcgtcctcgccgaacagcggcgcgccgaccagcaccacgtgcatgtcgggatgccgcgcggcggcctccagcagcacgtgctgccttccagtgcgcgaggcggctgaacgagccgacgagccatgcgtgctcgggcaaccccagccgcgcgcgcagcgcggcctggctgacgccttccagcgcatcgaacggctcggccgaaatgccgttgaacacgacgtcgacgtgctgcggcgtgaagcccgtcagcgcgcggaacgcctgcgcggacgcgtcggagttcgcgatcacgcgcgtgacgccgaaccgcgcgcagtacttgatcgccagcaactgcttgctgccgaaatggtcggtgctgacgatgtcgcgcaggtgccacaccaccggcttgcgcgcgagccgcccggccagcgcggcgaccaccatcgcgcgctgcgtgttcgcgtagatcacctcggcgcggcgcgcgcgccgcgccatcgcgcacgagccgcacgagctgcttcaccgcgccgaccgacacgccgccctgcttgcgcacgcccgcgagcgcgccctggtcgaccacgtcgacacgcgcgccaatctcgtcgagcgccgcacggaacgggccgtcgtcgaacagcagcacgtcggcgttcgcgcgcatgtgcttcatgatctcgagcagcgacagctcggcgccgcctagcacgccgctctggtcgagcacgagcgtcaccgggccgcgcgcggccggcggcggcgcgacggccgtaccgcgctgcgcggtcgagccgggcagcgcggtttccacgtagtcgagaaagcgccgccggaacgtatcggcggaaaaccgctccgcgttcgcgcggcatgcgtccggcgtgaaacgctgcggtgcgcgctcgaaatcgtcgacggccgcgacgatcgcatgcggcgtctgttcgtcgaagaagagcccggtcggattccggttcgactgcgggtcgagcacggtttcgagcgcgccgcccttgccgtacgcgatcacgggcgtaccgcacgcctgcgcctcgacgaccgagatcccgaaatcctcctcggccgcgaacacgaacgccttcgcgcgccgcatccggtcgtgcagcaccgcgaacggctggtagcccatgatctcgacgttcgggccggctttcgcgcggatcttctgcatctcggggccgtcgccgatcacgacgagcttgcgctcgggcgtcttcgagaacgcctcgacgatcaggtcgatcttcttgtaaggcaccatccgcgacgcggtcaggtagaaatcgtccttctccgcgttcagcgaaaacgcgtcgacgtcgaccggcgggaagatcaccgccgcgtcgcggtggtagaccttcctgatgcgccgcgcgatgaacgcggagttcgcgacgaaaccgtccaccgcgttcgcggtgcgcgtatcccagttgcggatgtagtgcaggatcatccgcgcgagcagcgatttcggcccgcgcgtgaggttcgactgttccaggtactggtgctgcaggtcccacgcatagcggatcggcgaatgcacgtagctgatgtgcatctggtccggccccgtcagcacgcccttcgcgaccgcgtggctgctcgatatcaccaggtcgtactccgacacgtcgagctgctcgatcgcgagcggcatcagcggcaggtagctgcggtacttggtgcgcgcgaacggcagcttctggatgaacgacgtcgtcaccggcttgccgcgcacgaacgcgcggtcgtcgaggaagtcgacgaggctgaacaggtcggcgtcgggaaaacgcgacgatctgttcgagcacgcgctcggcgcccgcgtaggtcacgagccagtcgtggacgatcgccacgcgcagcgcgcgcgacggttgccgcgcgctggcgcgctcggccggcacgggccggcgcagtgcggcgacatcgccggcttcggccgcggcggcatcggccgtggcgagattcaacaaggcgtgttccgccagatcgcgattcatcagtcgctccaagaagccctgccattgttggcgggaagaaaggagcgccgtcgacaaacggcattcctaggttagagtgaccggcatgattcttgtctatcgctaccgggtgaaatcgctcagcggtctgcttaacaagcagagccgagcggtgaactacgtctggaacttctgcaacgacacgcagaagcacgcgctcaagtggagcaagaggtggccgaccggcttcgacctgaacgtactgacaaccggcagcagcaaggagctcggcattcactccggcacggtcaacgcaacgtgtgagcaatacgcgaagtcgcgcgaccaccaccgacgcccgtacctgcgctatcgcggcaggaaatcgctcggctgggtgccgctgaaggggcgtgacctgaagcgtgaaggagatgcatttcgcttcgccggcaacacgttccgtgtgttcaacagtcgcccgcttcccgaaggcaagatcaaggatggaaccaatttcgcgcaggatgcgcgcggcaactggttcctgaacgtcgcgatcgaagtacccgaagttcccgcgcgcccgatccgttccggtgtcggcatcgatctcggtctgaaagaattcgccacactttcgaccggtgagaagcttcccaacgaccggttcggtcgacgcgcggcggaaaagctggcgaaagcgcaacgagcacgcaagcacaagcgccatatcgcgaagctgcacggcaaggtggcaaatgcccgcgccgatttccagtacaagctcgcgctcgatctggtgcggcgcttcgactacatcgcggtcggcaacgtgtccgccgccaaactcgccgggaccagaatggcaaagagcgtctacgacgcatcctggtcgtccttccgcaacaagctccgttacaacgcgatggcgcacggggtcacgttcgaggaagtcgacgaaagcggttctacccagtcctgttcgtcgtgcggatcgaaagacagcacgacgcggccgaaaggtatcgcgggactgcgaataagagagtgggcctgcagtggttgcggtgtcgtgcatgatcgggataccaacgctgctctgaacattctccgatgcggacgtgcatcgccagttgtgggaatccgctgctttcaagcaacggaagacgtcaagcggttctcctcgcattgagacggacaaacaggtcgcgcacgagcgcgcgcagccccggcgtcatcgtgagcgaccacgcgacgttcagcagcagcacgaccgcgcacatgccgatcgactcgacgagccccggccatgcctgcgccagaaacaggctcgccagcaggaacgcgaggtgcgcgagcatgtcgagcacgatcgcgcgcatccggatcgccgacaggtacagcagcacgccgtagtcgacgaacgcgcgcgccgcgacgaccaccgccgcgccgatcagcccgaagtgatggataccgaaccacaggccgccgacgaagaacggcatctggacgagcccggcaaaggccgcgcgggacggattgacctgcgactggatcaggatgcgcgtgacgctcgcctggccgacgagccacacgctgatcaccagcacgcggccgaccggcgccgaatgcgcggcaagatccgcgccgacccacagcgtgaggaacggcgcgagcgcgaagatcgcgacgatgccgaccggcgtgaacaccccgttcaggaattcgagcgactggcgcgcgagcgtgtccgcatggtcgcggccgaccgccgacaggcgcgggaacagcgtgcgcacgagcgcgttcggcagcatgttcaggcgcgtgacgaggttctgcggcaccgtgtagtaagtgacgaacttcgcgcccatgccggcgccgagcatcacgcggtcgagcgtgtcggcgatcatgctcgtcgtgctcgcgatcagcatccagccgccgaaattgaacagccctttcgcggtgccccactgcggcggatcgatgcgccggatcccgagcaccttgatgctggcgtgaccgagcatcaccgccgcgatcaggcgcgcgacgaccgccgcggcgagcaccgtctgcaggttcggcgcgatccaccacgcggcaccgagcggcagcagctggaacaggaacgtgccgatcgtctggttcgtgttgaacacgccgaaacgttcggcgccgttgatcgcaccggcgaacacccacgacacgttcgccagcggaatcgcgagcgcgagccacggcagcgcgagatacacctcgtgctgcatcaccgccgacaccttcgtgaagtaggcggtgtagatgaacgcgccgaaatagatcagcaacccgcccacgatgccggtgccgaggttcagccagaacgcgctccagaacacgcgcgcgctttcatcgccgttgccgctcgcgagcgccttcgagatgtggttctgcgcggccatgctcatcccgagatcgaggatcccgaaatagccgatcagcgtccacacgaggctgacgacgccgtaacgttcgacgccgagcgcgtggatgtacgcgggcaccgtcaccagcgacacgaaggtcggcaggatcagcccgatgaagttgatcgaaacgttcttgagtatgcctttgtccatgcttctgccttgtgtgacgtcgtccgtcacggtttccagcgatacatcagcaccttgccgcgcgcgtcttcctcgacgaacacgaggtactcgccgttctcgcgccggaacgcgctgatgccgaacggcacgtcgacccagccggatgccttgccgacctcggcgcccgggctcatcacgcccacttccttgccggtttccttgtcgtacacgtggatcttgccgaccggctccaccccgaagaggtagcggccctcggccgtgatcccgatcaggtcgaagatcggcttcgcgtcgagctgccacggcagcgcgacctggtagcgcacgaccggcgaacccgtcgaccacttgtcaaagcggaccagcacgcggcccacttccttattgatgcccggctgcggcggggcatcggccgtgtagccggtcacgtacagcgtgtccgtctgcgcgtcgtagatcgagcggcgcagctgcgtgaacggctgcggcatcggataggtcgtgaccttgtcgtacgagtagatcgggttgccggccttgtcgacgccgccgtactggaagcggtggatgccgcgcacgtcgctcgtgcgccagatgtcgcccttcgtgtcgacccaccagccccagccgcccgccttcgccttgccggtggtattgatctcgaactcgtcggcatcgagccggccgttgccgttcgcgtcgcgccacagccagtcgccgcccggcggcttgttcggcacgttgtcgaccggccgcgcgcggcccgcgatcagacccgacggaatcgcgacttcgccgtcgcgcttcgcgtcgaagcggtagatcttcaggtgatcggcgtacatgtccgtcaggtacaggaacgtgcgcccgtcgaggcgccgcgcgatcggcatgccgggccactggtccgtatggaacacggggtcgtccggacttgaagcggttcgacaggaagccgacgtatttccagtcccggcccggcggcttcgacaggtcgagctcgaagcgcttgttgcccgtgtacacgctgttcggccgcgccgggtcgagccatgcgccgtcgacgaacagcagcccctgcacctgccagcgcagcttgccgtccggcgtgtagctttcgagcacggcgccgagccccgcgccgatcgtgtcgtgacgcggcccgatgccgttcatcgacacgtagatgttgcccgcccggtcgacaccgacacccgtcagcccgttgaaacgctgcggcccgggccggcccggcaccgggcccgcgaagatgccgccgcgctcgccgagcgtgcccgactgcgcataacccttgccgcctttcgagaagatcaggatctgctggcgcggcccgttgtccgcgacgagcacgcgccctttcgcgtcgactgccacgtccaccgcgtcggtgccttccggcagcgcaggggcgtcgtcgagcttgcggccgtcggcgcgcacgtgcgcgaggtgcgcaggccccttgatcgtgtccgtgagcagccacaacgtgccgtcgcccgcgagcgcgatgcggcccggctcgtgcgcgctccacgtgcccttctgctgcatcgtctccgcgtcgtacacgtccaccgcgtcgcgcgtcggattcgtggcgaacagcgtcttgtcgtcggccgcgaggccgccgacctccgccttctgctcgcccgtttccgagcgcgcgggcgccgccacctcgttcatcatcatgaagctcgcggccatccgcgcgcggccggcatcggcacgcccgccaggagccacctgcggcgccgcgcggaacggcgccggctgcttcatgtcgccgatcgtgcggcgcgagatcccgaaccactgcttgcccttgtccggccagatgccgggcgactgcaggtggccgcgctcgttgccgacaccgatcgcgacgtacgcatatttgctgttcacggcgatcgcgctgccgccgaggttgccccagccgtgcgtgccgccggcgaaaccgagcatctttccgtcctggtaaatcgcttcggcgccgctctcgtcccatggcgcattcgtatacaccttgccttcaggcgtcaccgcgatcgcgcggatgtcgatctgcgtccagctgccgtcgccatagccgaacgtattgccgatccacgacgtcgtcgcgggcaacaccgtttcggccggtacggcgctcgtcagcagcgtcgcgcataccgtcatgcctaccagaatcagacgtcgcaatgcgcttctccagacttgatgcaagagcgaccggcaccgctgccggcgcaccctgtcgctaaatgggtttcaaacgtcgcgatgcaggttacaagcaaaaataatcacaagaaatttggaaatatttggggatgtttccgcctgaaatatcgaaccggaacagacgcgcaaagacacccgaaaacggcaattacgaccgcatttcgctttccagtctgtagaaaatgccgcttctcaccgcctggcgaggcctcccgggcggcgaccgttcatccccgaccgaaataaccggcatttgaatgtttgtcgtcggataaatgacgcgcgtttttgccgatttcttttcctagaatcgatttcgattcgatatttcatttaatggcatgcattacgttcacgtttacgcatcggatgtgcgactcgccccggctcaggccgcgcgtcgcgaaggagcggcgcgatgacgggcctctcgcgacccgcggcccccaccccgccgcaacacggccgcatcgtgcagctcgacgggctgcgcgcgatcgcggtgggtgccgtgttcctgcagcatgcgctgaaggcgccgctgtggatgggcgtcgacctgttcttcgtgctgagcgggctgctgatcaccggcatcctgctcgatcgcaaggcgcgcgggcagtcgtacttcagccacttctacgcacgccgcgtgcgtcgcatcctgccgccgtacgtgttgctgctggtggtgtcgacgatcctgttcggtgcgggctggctgccgcactggccatggttcgcgttcttctcgaccaacatcgggctgtcgctcggcagcatcggccacgacagcctcaacgtgctgtggtcgctcgcggtcgaggagcagttctacatcttctggccgttcgtcgtgctgtggtgctcggagcgcgcgctgctgtgggtcgccgccgcgctgatcgtcgcggcccccgtgctgcgcgcgatcgcgacgccgtggttcgactcgttctggccgatctactacctgacgccgttccggatggacctgctcgccgccggcgcgctgctcgcgatcgtgctgcgccgcgaccggcgcgcgctggaaccgttctatccgctcgcgatcgtcggcgcgcttgtgtcgctcgcgatcctcggctggctgcacctgtcgttcccgcgtttccgcgccgcgaacacgccgctgtcgaacgccgcgctctacagcatctcgctgctgctgtgcacgtcgatcgtcgtgatcgcgctgcgcggccgcggcctcgtgcagcgcgtgctgacgaacccgatgctcgtctacgtgggcaccgtcagctacaccgtgtacctgatccacctcagcgtgctgtacgcgctgtggccgctgcacctgaaccgtttcgtcacggccgcgctggcgctcgcgatcacgctcgcgtacgcgaccctgagctggtacggcttcgaacgacgcctgacccgcggccccgcacgcggcgcgctgccggccgccgccggcacgaccgcctgactttcaccctccatcgtttctaccaggacaacgtcatgagccaaactcgcaagaaggccatcatcaccgggatctcggggcaagacggcgcctacctgaccaagctgctgctcgacaagggctacgaggtcacgggcacctaccgccgcaccagctcggtgaatttctggcgcatcgccgagctcggcgtcgacacgcacccgaacctcacgctcgtcgaacacgacctgaccgacgccggctcgagcctgcgcctgctcgaacgcacgcagcccgacgagctgtacaacctcgccgcgcagagcttcgtcggcgtatcgttcgaccagccggcgacgaccgccgaagtgaccggcctgggtccgttgaacctactcgaggcgattcgcgtcgtgagcccgaagacgcgcttctaccaggcgtcgacgtcggagatgttcggcaaggtgcagtcgatcccgcagacggaagcgacttcgttctatccgcgcagcccgtacggcgtcgcgaagctgtacgcgcactggatgacggtgaactatcgcgagtcgtacggcctgttcggcagcagcggcatcctgttcaaccacgaatccgctgcgcggccgcgagttcgtcacgcgcaagatcaccgacaccatcgcgaagatcaagctcggcaaggcgacccgcctcgagctcggcaacctcgacgcgaagcgcgactggggttttgcacttgaatatgtcgaaggcatgtggcgcatgctgcaggccgacgaacccgacacctacgtgctcgcgaccaaccgcaccgagaccgtgcgcgatttcgtgcggatggcgttcgcggcggccggctaccagatcgaatggaccggcaagggcgaacaggaacgcggcctcgacgcgtcgaacggcaacgtgctcgtggaagtgaacccgaagttctatcgccctgccgaggtcgacctgctgatcggctgcgccgacaaggccaggtccaagctcggctgggaaccgaagacgacgctcgaacaactttgccagatgatggtcgaagccgatttgacgcggaatcaacaccatgacacgttctgaagccggacgcccgtcgcgccgtgcgtttgtcaccggcctgacgggcttcacgggccgctacatggccgagcgcctgcaggcggccggctatgaggtctggggcacggtcgcgcccggcgcggcgcgccccgacgatccggccttcgcgcactgcacgctgctgcccgtcgacctgctcgacgcacagcgctgcgcgcggcggccgccgacgcccggcccgatgcggtcgtgcatctcgccgcgcgcgcgcatgtcgcgcaggatgagccgtcggaaacctacgcggtcaacatcgtcggcacccgcaacctgctggccgcgcttgcgggcctcgaccgccgcccgtcggccgtgctgctcgccagcagcgcgaacatctacggcaattcgaccgccggcgtgctcgacgaaaccgtcgcccccgccccggcgaacgactatgcggtcagcaagctcgcgatggaatacgcggcgaaaccagggccgaccgtctgccgatcgtgatcgcgcggccgttcaactacacgggtgtcggccagagcgatgcgtacctgctgccgaagctcgtcgcgcactacgcgcaacgccccgcggatctcgctcggcaacctcgacgtgagccgcgatttctccgacgtgcgcgacgtgacggccgcgtacctgaagctggtcgaagccgcgccggccggcgagacgttcaacgtgtgctcggagcgcgcgtattcgctgaaggaagtgctggcgatgctgtcgcgtatcgccggatacgtgatcgacgtgacgatcgatccgcgtttcgtgcggcacaacgaggtgaagagcctgtccgggtcgcgcgacaagctgcggcgcgcggtgggcgagctgcccgtcacgccgctcgacgacacgctgcggtggatggtggaggcgatgcgcaacgacacgcacgccaacgcagatcgcaccgggtaagccgcgcgatttcatcggcacaaaaacgaagggccgctcgcttgcgcgaacggcccttcgtccatcgtcacgtcggatcacgtcacgacatgcgtgacgtgccgcgctcagccttccagcccgcgcgcgagatccttgcgcaggtcgcccgcatcctcgaggcccaccgacaggcggatcagcccttcgctgatccccgctgccgcgcgcgcctccggcgtgatgcggccatgcgtggtggtcgccggatgcgtgatggtcgtacgcgtgtcgccgaggttgccggtgatcgagatcagcttcgtgttgtcgatcacgcgccatgcgttcgcgcgctgctgttcgggcgtgtcgcccttcagctcgaacgacaggatcgccccgcccgccttctgctgacgcttcgcgagctcgtgctgcggatgcgattcgaggcccggatgaaacacgcgcgcgacggccggatgcgaatcgagccagcgcgcgatctccagcgcgttcgccgattgcttctcgacgcgcagcgacagcgtctccatccccttcagcagcacccacgcgttgaacgccgacagcgtcggcccgcgctgcgcacgaacgggaacaccttgcccatgatgaattccttcgagccgaccagcgcgccgccgagcacgcggccctggccgtcgaggaatttcgtcgccgagtgcatcacgacatccgcgccgagcttcagcggctgctgcagcaccgggctgcagaaacagttgtcgacgacgaacagcgcattcgatgccttcgcgatcttgccgatcgcctcgatgtcggcgagttcggtcagcgggttcgacggcgtctcgaggaagaacatcttcgtttccggacgcacggcttccttccacgcgttcaggtccgtcgggtcgacgaaggtcgtcgtgatcccgaacttgctgaagatctgcgagaacatcccgagcgtcgagccgaacaggctgcgcgagctgaccaggtggtcgcccgcctgcagcgcggacatcacgaccgacatgatcgcggccatcccggatgccgtcgcgatgcacgcctcgccgccctcgagcgccgcgaggcgctcctggaacatggtgacggtcgggttcgtgaaacgcgaataggtgaaatagtcttccgaattcgcgaagcgctccgcgtcggccgcgctctggaagcagaagctcgacgtgaggaacagcgcttccgagtgctcgttgaagtcgctgcgcagcgcgcgcgcacggcaagcgtgtcgaagttgaggagtcgtccatgttccgttttccgtatccgatggccacgcgcatcgcgcaggccagatcaaaaccaggccaaaaacaaaaagcccgctatgcgtcggcatcagcgggcttcggtgcggtacgacagcgatcgactcgggccggttgccaccggccttcgctttagctgttttgggaagtcgccccgcgtccgcaagctgatatcaaatcgacgcaaggccacatcctatcacgcctcgataaaagcgtgcgccggtgtcactcgaccgacagttgcaggttcatctgcgaacgttcggtgtcgccggccgtatcgcgatcggcctgcgacgccggcgtgaggcgcgcgcgctcgatcgcatcgagatactcgggcgtcacgtcgccggtgatgtagttgccgtcgaagcacgacgcctcgaagcgttcgagcttcgggttgatgtcgcgcaccgcgcgacgcaggtcgtcgacgtcctggtagatcaggtggtcggcgccgatgatcttcgcgacgtcttcgtcggtgcggccgtgtgcgacgagctcgccgcgcgtcggcatgtcgatgccgtacacgttcgggaacttcacgggcggcgcggccgacgcgaagatcaccgacttcgcgcccgcatcgcgcgccatctgcacgatttcatgcgaggtcgtgccgcgcacgatcgaatcgtcgacgatcagcacgttcttgtccttgaactcgatgctcatcgcattgagcttctggcgcaccgacttcttgcgtacggcctggcccggcatgatgaaggtgcggccgacgtagcggttcttgaagaagccttcgcggtactcgacgccgagcttcgcggcgacctgcatcgcggccgggcgcgacgaatcgggaatcggcatcacgacgtcgatcggcacgttcggcagttcgcgcttgatcttctcggcgagatagtcgcccatgcgcaggcgcacgttgtagaccggcacaccgtcgaggcacgaatccggacgcgcgaggtacacgtattcgaacatgcacgggttcagcgtcgggttctccgcgcactgctggctgtggaagttgccggccttgtcgatgaagaccgcttcgcccggctccaggtcgcgcacgaattcgaaaccgatgccttcgaccgcgaccgactccgacgcgaccatccattcggtgccgtgctcggtctcgagcttgccgatgcagagcgggcggatgccgaacgggtcgcggaacgcgagcaggccgtagccggcgatcagcgacacgatcgcatacgaaccctgcaagcggcgatgcacgcccgagacggccttgaacaccgaagccggatcgagctcgaggcccgtggtcgacagttgcagctcgtgcgcgaacacgttgagcagcacttcgctgtcggaattggtgttgatgtgccggcggtcgatccggaacatctcgtccttcagttgctgccagttcgtcaggttgccgttgtgcgcgaggatgatcccgaacggcgcgttcacgtagaacggctgcgcctcggcttcgctcgacgccgagccggcggtcgggtagcgcacctggccgatgccgtaggtgccgggcaggctgcgcatgttgcgcgtgcggaacacgtcgcgcaccatgccgttcgccttgtacatgtggaaattgctgccgtccgccgtcgcgatgcctgccgcgtcctgaccgcgatgctgcagcagcagcaggctgtcatagatcagctggttgacaggggattgggagataacgcctacgatgccgcacatggcatgtccttcagaatgacaaaatcggttccgtcctgcccagccgcgtcgtcacacgcgtacgtactgggccatgccgtcgggcaggagctgcttcagctcgtgcacgccctgttcggcgaaaggacgcaatagcgcattgcgccagaaatcctgtttgggcagttcggtcagcccggccgccgcgaccagcagcaccaccagcacgcagccgcggacgagcccgaacatcatgcccagcgagcggtcgacgccgcccaggccactggcctgcgcgatccgcgacagcagcgcgttcgcgacgccggcgaccagcaccacgccgatcacgaccaacgcgaaggcgatcacccactgcgtcagcgcaccgcccggccagttcgccggaatatacggtacgaccaatccgacgtagcggcccgcgatcacgatcgccgcgatccagccgatcagcccgaaaatctcggacacgaagccgcgccacgcaccgcgtagcgccgacaacacgatcaccgccaatacagcgtagtcgaaagccgtcagcatcgtgcgttactgcgtcagaccggcttcgcgcaccttcgcgatcgcggcggaagccgccgcgcgatccgcgaacgggcctgcacgcaacagtgtagccgtgctgccatccgactgcttgcgatgctcgacatatgcgggcacgcccgccgatttcaacttgtggcccacgaacgggccgtcgcgtcatccttgaacgacccgagttgcaccgcgaagcgcgcaccggccggcgacgacggcgacgacgcgtcgccgctgtccgggctcgcggcgtcggcattcgcgacggccgcgggtgcgggcttcggcgcagccggcttcgccgcgggcgcagccggtttcggcgcaggcttcggcggcgtcacgctcgccgtggtcgtggtatcgggtttcgcggccggcttggcggcatccttcggcgcgcgccggtgcggccgcaacggccgtgtcggatgccggcggttcgtcatgcgcgacgccggcctgcacgtcggacacatcgtcgtcgcgcggcgcgaccgcctggtgcgcgggccggttcgggatgtcgatcgcgatgtcgtcggtgaccggcttcgggcgaatcgagcaccatcggcagcacgatcaccgcggcgacgacgagcgcgatcgcgccgacgaggcgacggcgcgcacgttgcttttctggaagggtcggatcgaggagcagtgcgtccgattgcggcgcgagcgtcgctcgacgcgttcagtgcgctccgtgcgcacgttccggaggccccggtgcgaccgccgcgccgcgggggcgcgtcgtcgtctttcttgccgaacgagaaaattcccatgaatggctgagtccgaaactgcccgtcagtcagtgttgctgcgatttacggtaggccagcacgccggcaaccgtatggaaactgccgaaaacgacgattctatcattctcggatgctcttttagtgcatcgcgaaacgcttcggcgggcgacgtgtaacgcgtgacgctcgaatcgggcccgtcctccacgccggccttgcgcagcgcggcttcgagctgctcggcagtggccgcacgcggcagcggcaggtcggtcacgcaccagtggtcgatctcgcccttcaggtgctgcagcacgccgtcgatgtccttgtcgtgcatcgcgccgaacaccgcgtacgtgtacgggaagaaacccatgttgccgaggttctgctcgagcacggccgatgcatgcgggttgtgcgcgacgtcgagcacgatcgccggcttgccgggcagcacctggaagcgcccgggaagctcgacgttcgcgaggccgagccggatgtcctgcgccgacaccggcagcaccgggcgcagcgcctcgagcgcggcaagcgcggccgatgcattgatcagctgattcgcgccgcgcagcgccgggtacgccagcgccggatagcgcttctcgcgaccgaggtagctccactgctggcgctccgcgcctgcctgcgcctcgtagcggaaatcgcggccgacgagccacaggtcggcgccgatcgcttccgcgtggtcgatcagcgtttgcggcgcggccggatcgccgcagatcgccggcttgccggcacggaagatcccggccttctcgaacgcgatcttctcgcgcgtgtcgccgaggtattcggtgtggtcgatgtcgatgctcgtgacgatcgcgcaatcggtatcgatgatgttgaccgcgtcgagccggccgccgaggccgacttcgaggatcaccgcgtccagcccgcgcgacgcgaacaggtgcaggatcgcgagcgtcgtgaattcgaagtacgtgagcgacacgggctcgggcaacgacgtgcgtgcggcttcgacggcctcgaagtgcggcagcagctcgtcatcggtgacgttctgcccattcacgcgcgcgctcgttgaattcgagcaggtgcggcgacgtgtggcagccgaccttgtagcccgcgcgcacgaggatcgtctcgaggaacgcgcaggtcgaacccttgccgttcgtgccgccgacggtaatgacggggcacgcgaattcgagctgcagcgccgccttgacctgcccgatgcgggtcaggcccatgtcgatgccgaccgggtgcgcgcgttcgagatgcgaaagccacgcgtcgagtgggaaaagtgctcatcggttcaaatctggatcggtaccgccactacgccaaacgaagcgcgtcgcctgacgcggaagccaggcgacgcgcagagttcacaaccttgcgccggtcaagccagcgcgtcggccggctgtcgctgcagcagcgcgagcagttgcgcgatctcgtcgcgcatcttgcgacggtcgacgatcatgtcgatcgcgcccgtcttgatcaggaattcggcgcgctggaagccttccggcagcttctcgcggaccgtctgctcgatcacgcgcgggccggcgaagccgatcagcgccttcggttcggcaatcacgacgtcgccgaggaatgcaaagctcgccgacacgccacccatcgtcgggtcggtcagcaccgaaatgaacggcagcttcgcttcggccagcttggtcagcatcgcggtggtttcgccatctgcatcagcgacagcaggctttcctgcatccgtgcgccgcccgaagcggtgaagcagatgaacggcacctgctgttcaagcgcgttctgcgcaccgcgtgcgaaacgctcgccgaccaccgagcccatcgagccgcccatgaacgagaactcgaagcaggccgcgaccaccggcagcgtgtggatcgcaccgcccatcacgaccatcgcgtcggtctcgcccgtgtcgtccatcgcttccttcagacgatcggggtacttgcggctgtccttgaacttcagcgtgtcgaccggcacgacttcctgaccgatttcataacggccttccggatcgagcagtccgtcgaggcgctcacgcgcaccgatgcgcatgtggtgatcgcacttcgggcacacgtgcaggttcgcgtccacgtcgttgcggtacagcacggcctcgcaggacgggcacttgacccacaggccttccggaatgcccttgcggcttttcgggtcggtctgcttgatcttcggcggcaacagtttgtcgagccagctcatcgtatggtttcctgttccgtggcaggccgggccgcatggcccgttcgcttcctgtgttgtgtttatcgcgccgtcttgcccgcgccgtccagggcggcgcgcagctcggcaatgaaagtcttcagcgcggcggcggcaccctccggtgcagcgctttcgagcagctgcacgaggcggctgccgatcacgaccgcgtccgacacctcggccaccgcgcgcgccgtttcggcgtcgcggataccgaagccaacgccgaccggaaccggcacgcgcgacttgatggccgggattttacccgcaatgctcgaaacatccagatttcctgcgccggtcacgcccttgagcgacacgtaatacacgtagccgctcgcgatcttgccgacgtcggcgatacgttcgtcggtcgacgtgggcgcgagcaggaagatcggatcgatctgcgcggcgcgcattttctcggcgaacacgcccgcctcttccggcggatagtcgacgacgagcacgccgtcgacaccggccgcctgcgcttcggccgcgaacgcgtcgacgcccatccgttcgatcgggttcgcataacccatcagcacgacgggcgttttggggtcggtttcgcgaaagcgcttcacgtcggcgagcacgcttttcagcgtgacgcgcgcgcgcgcgcgcgttccgacgagcgctggatcacggggccgtcggccatcgggtccgagaacggcacgccgagttcgatcacgtccgcgccgccttcggcgagcgcgcgcgtgcatgaattcgacggtttcgcgggatcgatcgccggccgtgatgcgacgggatcacgcggcgcagcgagcgcgcgctcgtgcgcgatcgcacaatagctttcgttgatctcgtagccgacgaagtcgcgccctgccgtgcgcaggccaccgcggtcgtgccgctgcccatgaacggatcgagcacgcggccgcccggcgggcagcttgcgagcaccatccgctcgatgatttccagcggcttctgggtcggatggtcgacgcgctccgcgtgctgccggtgcaggcgcgagaccgaccagacgtccttcgggttgtagcccatttccagccacttgctgccttcgaacagcttgcgagagcgggcttcgtgtcggcgtcgtacgggatgcggaccggatcgagatcgaagtaatacgccctggaaaccgcgaaaaagccgatgttgtcgtgcaccgacgtgaaacggcgcgtcgtgccgcccatgctcggcacgcgccggtcccagatgatctcgttgaccatcgtgagctgcgtcttcaggaaactgaagatttccggcgcgtactgccacgtgcagaagatgtacatcgacccgctcggcttcagcttcggaatcgcgagctcgagccactcgcgcgtccacgcgagaaagtcgtcgcccgaacgcttgtccgagtcgttgccgtagtccttgccgagcccgtacggcggatcggcgacgatcaggtcgatcgacgcgtccggcaggtgcgcggcatcggtcaggaaatcgcggttgtgcagttcgatcccggacggcagcgcgcgcggcacggcggcggcgggctgaaccgcccccgcctcgctcgcggcaccgccgcccggttcttcgatcaggtcacgcatcggtcggggtcagagctcgatgcccgatcgctcggcgaccgtgtgcatgtccttgtcgccgcggcccgacaggttgacgagcaggatcttgtccttcggcaacgtcggcgcgagcttcacgccatacgcgatcgcgtggctcgactcgagcgcgggaatgatcccctcgatccggcagcagtcgtggaacgccttcagcgcttcctcgtcggtaatgccgacgtactgtgctcggccgctgtccttgagccatgcgtgctcgggaccgacgcccggatagtcgaggcccgccgacaccgaatgcgtctcgatgatctggccgttgtcgtcctgcagcagataggtacggttaccgtgcagcacgcccgggctgccggcgatcagcgacgccgcgtgatgccccgtgtcgaggccgtcgccggccgcttcgacgccgatcagctgcaccgacgtgtcgtcgatgtacgggtagaagatgcccatcgcgttcgagccgccgccgacgcaggcgatcaccgcgtccggctgccggcccgcgagctcgggcatctgcaccttgcattcgtcgccgatcacgcgctggaagtcgcgcaccatcatcgggtacgggtgcgggcccgcgaccgtgccgatgatgtagaacgtgctttcgatgttcgtgacccagtcgcgcatcgcttcgttcagcgcgtccttcagcgtgcgcgaacccgattcgaccggcacgaccgtagctccaagcagcttcatccggtagacgttcgcggcctggcggcgcacgtcttccgagcccatgtagacgacacactccatcccgaagcgggcgcagatcgtcgcggtcgcgacgccgtgctggccggcgcccgtctcggcgatcacgcgcttcttgcccatgcgcttcgcgagcagcgcctggccgatcacgttgttgatcttgtgcgcgcccgtgtggttcaggtcttcgcgcttcaggtagatctgcgcgccgccgagcgtctcgctccagcgctgcgcgtgatagatcggcgacgggcggccgacgaaatgcttcagctcgcgctcgaattcggcgacgaaatcgggatcgttctggaatttttcatacgccgcgcgcagttcgtccagcgcgtgaatcagcgtctcggcgacgaacacgccgccatacgggccgaagtggccgcggtcatcaggaaggttgtacatggtgtctctctcgatcggtcggggcgccccgttttcggggccgcgccggcttgcatcacccggcgtccgcttcgcgcaccgcgcgtacgaacgccgccatccgggcgtgatccttcacgcccttcgcgccctccacttcgatgccactcgagacatcgacagcaaacgggcgcaactggcgaatcgcatcaccgacgttttgcgcgctcaagccaccactcaaaacggcccgatgcgcgagctctgcgggaataagagaccaatcgaagaccttgccgctaccgccgtaatccggcaccagggtgtcgaacaggaggccgcgcgctttcgaataatgaagtgccgattctaccaaatcggccggctgcgtcgagggccgacgcgcaccgcgcgcaaccacggcaggcgtgccgcgcggccgagggcgtcgcactgcccgggtgtctcgtcgccatggaacaagcagcgtgagcggcacgtcgcgcacgacggcctcgatctcggcttcggtcgcattcacgaacagcccgaccaccgacacgaacggcggcgcgaggcgcgccagctcggccgcctgcgcgatcgtcaccgcgcgcgggctcttcgggtagaacacgagaccgatcgcgtcggcgccgagcgccgccgcgtgcagcacgtcctcggggcgcgacaggccgcacagctttgcgcgcggcggcaggccggccgcggcgggagtcgaaggagacacggcgtgatccgtcatggttgagggtccaggtcggcccagacgctgctccacggcacgctgccgagctgcgcgggcgggacggcgaattccgccgggtagccgacgtgggcgaggtacagcccgtcggccatgaacgtgggcgccgcgagattgcggtcgcgcccggccagcacgtcggcaagccagtcggccggatagcggccgcggccgaccgcgacgaggcagcccatcaggttgcgcaccatgtggtgcaggaacgcgttggcgcggaaccggaaatgaatgaaatggcccacgcgccgcacgtcgatctggtacaggtgtttgaccggcgtcttcgactggcattccgacgaccggaacgacgagaagtcgtgctcgccgattaggtgcgcggcggcggcgcgcatcgcgtcgtcgtcgagcggcgtatggatccagcccgcgcgccccgccagcatcggcgagcgcacgggatgcacgtacagcgcgtagtaataggtgcgctcgaacgccgagaaacgcgcgtgaaacgtctccggcatcggcttcgcccattgcaccgccacggtcggcggcaggaacgcgttggtcccgcgcacccacgagaacacctcgcgatccaggtcggtatcgaaatgcacgacctgcccgagcccgtgcacgcccgtgtcggtccgcccggccaccgtcgtatgcagcggcacgcgcgcgaactcggccagcgcgtgctcgagccgatcctgcacggtcttgccgtgcggctgcgcctgccagccgcagaacgccgcgccgtcgtactgaatgccgagcgcgatccgcatcacgcctcgtccgccagtttcgcgagcagcgcacgcgcatcgtcgcgcgtcgcggtgtcgttcgcgtcgaccacttcctgcagcagcgtccgtgcgccggacagatcgcccagctcgacgtattcggtcgcgaggtcgagcttgttgcgcgcgatgcgggcgagttcgtccggcgtcagcgccggcaacgcggcgcccggcgtcgacggcaggtccagatcgaagtcgagcttcagtgcgccgaactgcgcgccgccgagcggcggcagcgacgacgtcgcgaacgggctgcccgcctggccggctggcgtcgccgcgtccggatcccaatcgaactcgtcgtcctgatcggccggatgttcggggccggatcgatcgcgccaatcggaaggcgcgagtcgacttgaccgttagttgcgactttatcggtgtcggactgccttgcctgcgcggcagactcgtccgtcgccagcgacggctcgtcctgcgtgcgcggcggcagcggcatgtcgaggctgttgagcgcgctgatcgcgttctgcatcagcgcctcgtgctgcgtttcggcggccgcgggggcgctcggcgtctcggcaggctgttccgcgggctgttcggcagcgatcttctctaccggctcggtatcgtgcggagccggagccgcctcgctcgcggtcggcactacggcgtgcgcggccggcaattcgggctgctcgtcatgcgtcggcaccacttccggcgccgacggcacatccgtatcaggcgtctcggccgtctccgccgctgcggcagtggccgcggcaaggctcaaatcggaagccgcgtcgcgtgcgaccggcatctcgggccggatcggcagttccggctcgacggacggcgcggcttcggtttctgccgccgcagccgcggacccgcccgcgacgaccgcagcagccgtcgcgctcggacccgcatcacccgtttcttccgcgcgccggcccttccggcgcttgcgccacgcaaaacctgcggcgaggacgatcacggccgcaccggccaccgcggccggacgccagtccatctgcccggtactgcgcgcagctgccgccaccggcgcggccggttgcgcgggcgccgataccgatgccggctgcgctgcgctggcagcaacgccggacgcggcttcacttgccgccggcgtggcagcggatgcgcccgtatcgttcgcggccggacgcggtgcgacaggtgccggcacgggcgccggcgcgacctcgttcgtcgtggccggcttgccgatgccgtgcttctgcaactccatcagcacgcggttcttcagcgccagcagttgttgcaggctcgacggccgcggctgcgacgcgcccgcggcgggcgcagccccggccggttcgttcatgcccgaaacctggctgcccgcaacaggcggaagcgcagcaccgctcgcggacgacggcatcgactggatcgcaccgctccacacatgcggaccgcttgcaccggcaacgggcgccgccggctgcacgctttcgacggccgatgcgccgtgtgccgccgaagcgccgagcgatgccgccgcaccggcggccgtcgcgacgctcgcaccgctcaccggagccgcatgcacggccggcgccaccggcgcggacggcacggtcgccgccggggtcgaccccggatggggcgccgacgcaccatgctgcgcgaccgccgtgccgccggatgccgccgcgggcgcggacgctgccgccgtacccgatgcgccggatgcgccggatgcagcggatgcaccggccggtgcgagtgccgtgcctgtcgcatcgagcgccggcacggtcagcgtcgcaccgactttcaggcgactcgcgtcgtgcttcatgaacgcctgcggattggcgtcgaacagcgcgcggccgcgcgcgcgagcacaccgggatcgcgcgactgcgtggccgctttcgcgatgtcgttcagcgactggccgggctggaccgtcacggtaagcggcactgcaccgccggcagcggacgccggcagttcgccggtgccggccgcccaggccgatgcggttgcgccgagcgccaggatcgccagcgcgccacgcacggcgcgcgacagacgggactgacgcggaaacaaggaaattcgggacatcgttggctctatcgccgcgcgtgggcgcggctcggattcgcggttgaaagcgtcaataaagttgccgcagaaatgcaaaagcgtcgcgttgaacgcgacgctttcggcggtctgtgcgtcgtaaccgcgtagtttacttcacgtgatcgggttcgggccgaattcgtcgccgatgggtgcaaccggccgcgttcgcgcgtccgtgggcccgcctgccgggccgtcccgatgcccgggttcacacggtgcgaccggcgctcccgatcgatcggaagcacgcctccctcaactgaaagatgcccggccgcatcccgtcccgaacgaatggcgcgcccttgccgctcacccggcgccctgcccaccggggctcgatgccgcgccacgaccgcgaaatcgggcacgtttgctcaataaatcgcgccacctgccgttaatggattagcaatctccaataaaaacaaatcccgccgaccaccaaaacaattcaaataaatttcaattgatcgataagaggccaattcccatctcttatcgtcgcattggacatctccatcctcaaaccccgccccacaaggctttcaagcctcaccccagtttcattgctcagactaaatcaatcatttcgacagcaattcaattacattacacaaaattacacagatcgaataattgccgtcgctacgatcgtcttcaaacaagaatcggcgcagttcgaccaccgcgtacacacctgcaggaaaggcaggcacgcgcctggccaggctgacgtcgtgaggtgccaggaggcatcgcgcagtcgcacgactgcatctactcaccagctcgttacggggatcgaacatgggatatcaacagggtttgagcgggttggccggcgcggcgaaccatctcgacgtgatcggcaacaacatcgcgaacgcaaacacggtcggcttcaagcaggggcgcgcgaacttcgccgacatgtacgcgaattcggttgcgacgtcgaccaacacgcagatcggcatcggcacgcggctcgcgtcggtgcagcagcaattcggccaggggacgatcaacacgacgaagtcgtcgctcgacatcgcgatcaacggcaacggcttcttccagatgtcgaacaacggcgtgacgacgtactcgcgtgacggcgtattccaccgggacaagagcggcgccatcgtcgattcgcaaaaccgcaacctgatgggctatgcggcaggcccgggcggcgcgatcaataccgcggcgaccgtgccgttgcaggcgccgaccaacaacatcgccccgcaggcgacgacgaagatcaccggccagttcaacctgaattcgcaggacaaggtgccggccaagacgccgttcaacccgggcgacaacaccacgtacaactacaattcgtcgatccaggtgtacgacacgctcggcggctcgcagcaggtgtcgatgtatttcacgaagaacgcggccggcacctggcaggcctacgcgggcgtgcagggccagacgccgacgaatctcggcaccgtcacgttcgacacatcgggccggatcacctcgacgacgtcggccgccaccggccagccgacgccgagcctcggtcagttcgcgttttcgatccccaacgcgtcgggcggcgccaatccgcagaacctgacgctcgacctgggcggcacgacgcagttcggcggaaaaagcggcgtgaccaacctcgcacaagacggcttcgcgagcggcacgctgacgacgttctcgatcggcacagacggcaagctgaccggcaattactcgaacggccagagcgcagtgctcggcctgatcgcgctcgcgaacttcaacaacccgaacgggctcgagaacattggcggcaatcagtatgtggaaaccgccgcgtcgggcgtgccgcagatctccgcgccgggcagcacgaaccacggcacgctgcagggaagtgcgctggaaaactcgaacgtcgacctgacgaccgaactcgtgaacctgatcaaggcgcagcgcgattaccaggccaatgcgcagacgatcaagacccagcagactgtcgaccagacgctgctgaacatgcgctgacgcgcacatgaaaaacgcgccgcgccagccttgatatcgtcaaggccggcgcggcgcgccatctgtgtaacgcggcccgcgcatcgcgggccggacacacgagcttacttgtcgagcaggatgcgcagcatgcggcgcagcggctcggccgcaccccacagcagctggtcgccgaccgtgaacgccgacaggtattcgccgcccatcgcgagcttgcgcagacggccgaccggaaccgtcagcgtgcccgtgacgttcgccggcgacaggtcgcgcatcgacgcttcacgctcgttcggcacgaccttcacccagtcgttcgccgacgcgaggatgccgttgatctcgtcgagcggcacgtccttgttcagcttgatcgtcagagcctgcgagtggcagcgcattgcgccgatccgcacgcacaggccgtcgaccgggatcgaacccggctcgcccatcgccggcttgccgagaatcttgttggtttccgcgccgcccttccactcttccttcgacatcccgttgccgagatccttgtcgatccacgggatcagcgagccggcgagcggcacgccgaagttgctggtcggcatcgcgtcgctgttcatcgcggccagcacgcggcggtcgatgtcgaggatcgcggatgccggatcggcgagctgctccttcaccgcgccgttcagcgtgcccatctgcgacagcagttcgcgcatgttctgcgcgcccgcgcccgatgcggcctgataggtcatcgccgtcatccagtcgacgaggttctcgcggaacaggcccccgagcgccatcagcatcaggctgaccgtgcaattgccgccgatgaagttcttcgtgcccttgacgagcgcatccttgatcacgtcgaggttgaccggatcgaggatgatgaccgcgtcgtccttcatccgcagcgacgatgccgcgtcgatccagtagccgttccagcccgccgcgcgcagcttcgggaacacgtcgttcgtgtagtcgccgccctggcacgtgatgatcacgtcgcacttcttcagctcgtcgacgttggtcgcgtccttgagcgtagtctcgtttttcgcgaacgacggcgctttgccgcccgtgttgctggtgctgaaaaacaccggttcgatcaggtcgaaatcgccctcttcctgcatgcgctgcatcaggacgctgccgaccatgccgcgccaacctacgagacctacgttcatgactaaccctttgatggagcttcccgccatttccgtccccggtgtgaccgcgcggggaaataggcggcacgacggacgatcagcgtttaatgatcgttttcgtggtaatggttttcgtgatgacgatggcgcgcgcacccgcacgggcaatgttgccgtggagtttcaagaccggggagatcaggaaatttgcgccatcgttcgagttcacaaagccggttgcccgcacaacggccaaccgcgcgcgaaccggccgatttcgcggcccgttcgcgccctttctacttgcttgcgttacagcgccgcgaccaccgcgtcgcccatcgccgtcgtgccgacctgcttgcctcccggcgtcgcgatatcgcccgtgcggtagccctgttcgagcaccgttttcaccgcgcgctcgatgcgatcggcctgctccgcacgattcagcgagtaacgcagcatcatcgcggccgacaggatcgtcgcgagcgggttcgcgatgcccttgcccgcgatgtccggcgccgaaccgtgcgacggttcgtacaggcccttgttgttcttgtcgagcgacgccgacggcatgccgatcgagcccgtcagcatcgacgcttcatccgacaggatgtcgccgaacatgttgccggtgacgatcacgtcgaactgcttcggcgccttcgcgagctgcatcgccgcgttgtcgacgtacatgtgcgacagctcgacgtccgcgtactccttcgacacgtcgatcatgatgtcgcgccagaactgcgacgtttcgagcacgttcgccttgtcgaccgacagcagcttcttcgcgcgcttgcgggccgcctggaacgcgacgtgcgcgatgcggcgcacttccggttccgaatagcgcatcgtgtcgaagccttcgcgttcgcccgcgaacaggccgtccggtgcagcacgcacgccgcgcggctggccaaagtagatgtcgccgttcagttcgcgcacgatcaggatgtcgaggcccgcaaccagctcgggcttcagcggcgacgcatcgacgagctgcgggtagcagatcgccgggcggaagttcgcgaacagctcgagatgcttgcgcagcccgaggatcgcctgctcggggcgcagcgcgctcgagcgagtcgtacttccagtcgcccacggcgccgaacaggatcgcgtcggcttccttcgcgagcgccagcgtcgcgtccggcagcggatgaccgcttgcctcgtagcccgcgccgccaaccggcgcctgttcgagttcgaacttctcgtcgagtgcgttcagcaccttcaccgcttcattgacgatttccggaccgatgccgtcgccgggcagcactgcaatcttcatgcgaaattcctgactggataggttttatgaggcaggccggcgagcgccgccggcgcccgcccgaaaggcacgtcagccgaccagcttggtattgagccacggctgcttcacgaggcgctcggcctcgaactggcgaatcttgtccgcgtggcgcagcgtgaggccgatgtcgtcgaagccgttcagcaggcagtacttgcggaacgcggcgatctcgaacggatactcgcggccgtcgcccgaacgcacgacctgcgcgtcgaggtcgatcgtcagttgaaaaccattgaacgcagccgtctcgttgaacaggtgatcgacctgctgctcggtcagcacgatcggcagcagcccgttcttgtagcagttgttgaagaagatgtccgcgaagctcggcgcgatgatcgcgcggaagccgtactgctgcagtgcccacggcgcgtgctcgcgcgagctgccgcagccgaagttcttgcgcgcgagcagcacggatgcaccctggtagcgcggctggttcagcacgaagtcgggattcagcgggcgcttcgagttgtcctgacccggctcgccgtgatcgaggtaacgccattcgtcgaacgcgttcggaccgaagcccgtgcgcttgatcgacttcaggaactgcttcgggatgatcgcatcggtgtcgacgttctcgcgatcgagcggcgccacgacgccggtatgcacaatgaattttccatgatccgtctatccggttgaagggccggcgttcagccggcgcacatcgacaaattctcggcgggaatcgtcactccgcggcgcgcttcagcgcattgccggcggcgttgacgtcctgcccgaagccctggacggtattgcagcccgcaaggccgaagcccagccccgcaagcgccagcgcggcaaccagccgcgttatgaccttcgatgccgtcacgcgttaccccagcttgcgaatgtcgacgaagtgaccttcgatcgccgcggccgccgccatcgcgggctcacgaggtgcgtgcgaccgcccgcaccctgccggccttcgaagttgcggttcgacgtcgacgcgcagcgctcgcccggatccagccggtcggcgttcatcgcgaggcacatcgagcagcccggctcgcgccattcgaagccggcgtccgtgaacaccttgtcgagcccttcgcgctcggcctgcgccttcacgaggcccgagcccggcacgaccatcgcgagccgcacgttcgacgcgacacgacggttcagcttcttcacgacgtacgcggctgcgcggatgtcctcgatgcgcgcgttcgtgcacgaaccgatgaagatcttgtcgaccttgatcgactcgatcggcgtgttcggctcgagcgccatgtaggccagcgcacgctccatcgcgtcgcgcttgaccggatccttctcgcgttcgggatcgggcacgcgaccgtcgatcgacgtgaccatttccggcgacgtgccccacgtgacctgcggcacgatctcggccgcgttcagctcgaccacgcgatcgaactgcgcgccttcgtccgacttgaactggcgccagtattcgacggcctgatcccattccgcgccggtcggcacgaacggacggcccttcaggtaatcgatggtcgtgtcgtccaccgcgaccatgcccgcgcgcgcgccggcttcgatcgccatgttgcagacggtcatgcggccttccatcgtcagcgcgcggatcgtcgagccgccgaactcgatcgcgtagcccgtgccgccggccgtgccgatcttgccgatgatcgcgagcacgatgtccttcgcggtacagccgcgcggcagcgcaccctcgaccttcacgagcatgttcttgctcttcttctgcagcagggtttgcgtggcgagcacgtgctcgacttccgacgtgccgatgccgtgtgcaagcgcgccgaacgcgccgtgcgtcgacgtatgcgaatcgccgcacacgatcgtcatgcccggcagcgtcgcgccctgctccggcccgatgatgtggacgatgccctggcgcacgtcgttcatcttgaactgcgtgatgccgaacgcatcgcagttcgcgtcgagcgtgtcgacctgcagcttcgagacgggatcggcgatgccgtggctgcgatcggtggtcggcacgttgtggtccgacacggccaggttcgcgctgatgcgccacaccggacgctgcgcgatcttcagcccttcgaatgcctgcgggctcgtgacttcatgcagcagctgacggtcgatgtagagcaaagtcgtgccgtcttcctcggtgtggaccacgtgggtgttccacagtttgtcgtagagagtctgtgccatgggtatgcggggtcgttgtgactacaagccttgcggatgcggtcgattatgccacgcagaacgcgtcacggcgcgggccgcgcgcgaaaaaccattaaaaacagtggtttggctggtagtgccaatacctgtatcggcattacccggcaaatgcgggcgcgaacggcgcggcggcggttgcagccgtcgcgtggggcgcatgtcgcggcgacacgcgccggctggccgccttcgcggggtcggtatcgcgctgcacgcagaagcgctgcgcgtcctccggcgagtggaagcggccgttgcggaacaacacccttcgctgcgacgtgtcgtgcagcgacggcgtcttgaacggcccgtagctcgcgattgcgccgcacaccgggcgcccggaacgtgaagtcgttcggcggtggatgccgcgagtgccccgcagcgtcagccgttcgggtattcgcggttgatcaggtcgagccgcagcatcccgagttgcacgccgacgttgctcagcaggtaaagatcgcggcgccgcaaggccggcatctgcgcggacgcgtcgtagagcgacggcagcgtcaggcccgccggcaccgcggcctgaatccccgcggttttcgacacgcgcacggcaatcgaagcctgatccgaatgcgtgacgacaccgacgttgccgagtgtcgacgccgagccggcctgcctgacgatcgcggttacgacgccgtcgggcgtcggtatcggctgccggcggccggcgccggtgtcgcgatcgacgtcacgccggccgtcagcccgtacttcgacgcgagcacgctcgcgacttcctgctgcgcaaagatccgcgcggcgaccttctggcgcagcaggaacacggcgtcggcaatcgcctcgttcacggggccgggcaccggcgcggcgcccgacgacggcgcggcgcgactgccgaaagcgaatgcggcaatcgtgttgatggccgtggcctggacggtcggcggcgtccacgagaaaacgtctcgaacaggtaaccggcctcgtcggcggcggctgcgcggtcgttcagttcgttcgtcagcttgccgagcatctggcgttgcagttcggcatctgaaacgggagcgtcgccggcgaagcccggcgtgctggcggcaccggtcgcggcaagcgcggcagcggaagcgaggaaatggcggcgggtctgcatggtcatcggaatcgggagaaagaaagtgcgtcagcccttcgggaacgcctgcatcgtcgcgccgaccgcgcgggcgagcatctgcgcatacatgtcgtgcacgaggtacaggctgcggttgcgcgtccacggctggcccgactgcgggtcgtagcgcgtcggcaacggcacctcggcaaccgcggccgccttcatgcccgcctgctgcgaggtctggatgcagcgcttcgcgtgatcccgatggccgaccaccgcgacgcggcccatcgcggccgcgccgcccgcgcgtgacacggcctcggcggccacgccggccgtgctgaggtacacgatcgtgccgtcgctcgcgatcacgggctcgatcgacgacagcacgtcggcgcccatcccgtatttcgacacgagaaagcgggcgatttcccactgcgcgtagaccttgaccggcttcagttgccgaatgcgatagacggcgtccgcgagcgcttcgttgacgggccccggatcgggcagcgcggactggttgccgcccgtgctcgacgtattgccgcttgccgcgttcgggcgattgccgaagctgtacgcgacgatcgcgccggcctgggccgccggcatcgtcggcaggtcccaggcaaacccgacgtcggtcagcgccggctggatcgcgccgaccgtcgcggcatcaccgagctgcgcattcagcttcgcggacatctgcgcggccagcgcggcgtcggtaacgggcatcgacgtgacgtcgtcgccgccgcatgcgctcagcagcggcaccgccgcgacggccggcgcggcggccaggaattttctgcgtgaggaagccagcggattcagtttcatgagaaatacgaaatgatgcgaatgacgtcgacgcgatacctcggcgtcgcattcacggtcacgggaaatcgcaatcgggcgagtcgcgcaggcggcgacggacggcagtaccgcagcgcggaccgaatcgccgcgcttgcgtcgattgacgagcccggatcgtagtcggcgtttgttaaattgcggtgaagctcgcgagccaatacgcgtaatcgcgtcgtcgtttcgcggatggatgcctgcgtttcacataaggtgagcgcctgcgcgattcgttccacggatggcgatcatgcgccccgcgaaacttcccggcatgacgcgctacgatggcgcaacgcacatgggcaatccccacgccccgaacccggagtacaccacgatgaagctcggcctgaacgaatcgctcgcccgtctcgacgaagaaggcacgctgttcacgacgctgtttcgccacggcacgctcgacgtcgagctgtaccggccgcgcatcgaggacaagcagaagccgcacacgcgcgacgaggtctacgtgatcgccaccggcacgtcgcacttcgtcgtcgacggacgcgaatgcgcggtcgcggctggtgacgtgctgttcgtcccggcacacgccgaccaccgcttcaccggcttctccggcgacttctcgacctgggtgttcttctacggccccgagggcggcgagcgcggcgcgtagcgcgcgatggcgatgcgctgcacttttcccgcgatcgcctagactgtctattcgcagcgggcggcgcgcgacgcgcggccgcccgatcgtcacgatgccggtggcggccgcttcaacgaacgggaaaacagcatgcgatacgaactgtattactggcccgagatccagggccgaggcgaatatgtgcggctcgcgctcgaggcggcggaagccgactacgtcgacgtcgcgcgcgaatcggggcgcggcatggggtgccggcgatgatgcgcatgatggacagcgcgaaggcggaatgcgtgccgtttgcgccgccgttcctgaaagccggcgacctggtggtcgggcagaccgcgaacatcctgctgtttctcggcgcgcggctcgggctcgcgccggacgacgaagccggccggctgtgggtgcaccagcttcagttgaccgtggccgatttcgtcaccgagatccacgacacgcaccatccgatcgcaagcggcctctactacgaggaccagcaggcggaagccgccgagcgcgcggccgatttcctcgaaaaccggctgccgaaattcctcggttacttcgagcgcgtactcgaccagaacccgcacaagagcggctacatcgccggccacgcactcagctatgcggacctgtcgatattccagttgatcgaggggctgcgttacgcgtttccgaaagcgatgaagcgcgcggagcggaaaatcgcggcactggtcgcgctgcacgaccgcgtcgcagagcatccgccggtggcgcgctatctcgcgtcggaacgccgcatcccgttcaacgacatgggcatcttccggcactatccggagctggacaagtaacgccggcaccgcatccgcgccgcctcgggcagggcggccgatgccccgctcacgcgacgaccggcgtctcgtgcaaatggcgccatacgatcagcccgtccgcctcgcgccggaacacgaccgtcgagcgccgcaccgtgcgctgcccttgcgcgtcggtctgcgtctcgcgatagccgatcgtcgcgccatcggaccacacggcaagcccgcgcaactcgtcgatgtcgatcaccagcccggggcgcgcgccgtgcccgtgaaaacagcgcatcgatgcccgcgtaatcgagcaccgtgcccgacatcgtgatcatcgaaaatcccggcgaaaaacgcgccatcagcgtcgcgagccgctcggggccggcacggccggacaaccagcacgcgatgtcggcaacggtgtcgacgacttccttgaaatacggattcggcaaattcataaggctctcaggttctcacgagtgggatgaaacgggttgcgcgaccggcgcacggtatgcgggaagccgtgcaatcaggcccagcggcagcaacgtcagcacgaccgccagcccgaagcaccagcggtacggcgcgagcgacggcccgcccgcgtcgaatgccagcaacgcattgagtgcgctgccgagcacggccacgccgacgcagaagctcaactggcggttgatattccacagcgcgctcgcgtcgcccatccggtcggcaggcacatcgacgaacgccgcgctttgcgacgtgctcgtgcacaggcttgcgccgaaccccatcgccgcgaatgccgcgatccgcacggcttcgacgccggcccaggggtcgcgagcagtgcgatgccgacgcaatcgatcgcgatgccgctcgcgaacaacggcttcgcgccgtggcgcgcgaagcagcggcgcgtggtcgcgatcgcgaagcacgccgcgatcgcccacggcagcatcagcgcgccggcatgcgcagcgctcaacccgagcgcgttctgcagatagagcgacgcgacgaggttgacgcccgtgaagacgcccggcacgcacagatagaccaccacgccggttcgcagcagcggctgggcgagcagtcgcaggtcgacgaccggcgactgggcgcgacgcgcatgcgccgcatagcctgcgcctgccgcgctcgcgacggccagcatcgcgagcgggaataccgcgccgccgggctgccccgcggcggtcagcccgagcagcagcgcgacgagcgtgaccgcactcaggccgagccccggccagtcgagccgcggcggccggtcgcgcgcgccgtcgcgcggcagccatgcgaacgcgagcgcgcaggtcgcggccgcgatcggcaacatcgcgaagaagatcgcgcgccacgaaccgcgatcgacgatcgccccgccgatcgccggcgacaacgcgggcacgagcagcgcgaccatcatcacgaccgacgtgagccgcgcccgcgcctgcggcggatacgcgcgataggccatcgtctgcccgaccggaatcagcagcccgccgccgagcccctggaccagccgccacgcgagcagcgtctcgatcgacggcgacgcgccgacgccggcactgccgagcccgaacagcagcagcgatgcggcgaacacgcgccgctcgccgcaacggcgcgcgagccacgtgccgaacggaatcacgacggtcaggccgagcacgtacatgttgccgacccacgcaagctgcgcgaccgacgcgtgcagttcgcgctgcagcgccggatacgcggcgttcagcatgaacatgttcgcgaggtcgatcgcgaagccgagcaggtagacggcggcgattctggaacggtctggcatggcggcgggaacatcacgaaacgccgcagtgtagaagccggcacgcgcatcggtaagcggccggatgcgacgagtcccgtcgaatttttgacaatcggatcgcgccgccacgacgccgcgcggccgcacattcgggtacccttcgagcgatccaacagccagacaggacccacgccccaaccatggtgagcctcgatcgtttcgccgttttccgtgccgtggtcgaagccggttcgttcacggccgccgccaccgcactgaaccaggcgcgggcggccgtcagtttcaacgtgaagcagctcgaagccgagctcggtgtcacgctgctcacgcgcacgacccggcgtgtcgagctgaccgacgccggcgagcgcttctaccagcgctgcctgcgcgtgctcgacgaagccgaaggcgcgatcgacgaggtgcgcggcgagcacggcgggatgcagggcatgctgcgcgtgacgtctacggtcgagtatgcggcgcgcgtcctcgcaccgatgctgcatgcgttcaccgcgcagcatcccacgttacgcgtacggctcgaaacgcatacgtcgcaggccgatctcgtgcgcgaccgcttcgacgtcgcgatccggctcggacgccacgagcactttcgcgacctgccctatcgcggcgtctgcctcgccacctacgacgtactcgccgtgatggcgcccgacctgccggcgaaggccgggcgcccgaaaccggcgtcgcccgacgacctcgcccgccttccgcagctcggccacagccggctcgagcggatcgccgaatggacgctcaccgatcgcgcgggcaacgaacatgcatttcgaccggccgcgaagcctcgcgtcgtcgtcgacaacgcatcggtgttgcgtgaactcgcgcgccagggcagcggcgtcgcgctgctgcccgaatggctcgtgcgcgacgatctcgaaagcggcacgctggtcgatgcgctgcccgcgtaccggtttccgcagcagaacgtctacgcgctgtacgtcgcgacgcggcacgtgccgcagaaagtgcgcgcgtgggtggacttcatgaaggcgcggttgcagcacgcgcactgagcgcggtttgcgtgcgccgccgcgcgcgggccgtcgcagcgaagccggccgtccgatgcgaccggcttccgttgccgcactttcggcaccgcgccttcaataccgacaagtcagtgcaggtgctcgtgctgcgtggccgccgcatcgacggcctcgaccgagcgcgtcagccacggcccgatgtccatctcctcgtagcgcacgagccggctcttgcgcgcccggcgatatgcccaccagatcgcgacgaacagcggaatccacacgtagatcgacagcacttccatccagtcgatgcgggccgcgaagaacgcctggtaatcctgcccgagcgagatcacgatgcagatcgcgatcgcgaacagcggcccgaacgggaaccatttcgcgcggtacggcagttgatcgagccggtagccctgcttcaggaaccccttgcggaaccggtaatggcagaccgcgatgccgagccacgcgatgaaacccgtgatgccgaccgtgttcagcagccacagatagatgctctggttgttggtcagcgacgtgaggaagcacagcccgccgacggccatcgtcgcgtacagcgcgttgcgcggcacgccgcccggcgacagcgtcgcgaacatcgccggcgcgcgcccttccgccgcgaggttgtacagcatccgcgtcgccgcataggtgccggagttgccggccgacagcacggccgtcaggatcacgagattcatggcgccggcggcgagccggaaaccggcatggctgaacaccagcgtaaacggactcacgccgatgtcggtcacgtcgctcttcaacaggttcgggtccgtgtacggcaccagcaggccgatcacgaagatcgcgaacacgtagaacagcatgatccgccagaaaatctgcttcaccgcgcgcgggatcgtcttgcgcggattctccgattcgccggcggtgatcccgaccagctcggtgccgagaaacgagaatcccgcgatcagcgcgacgctcatcatcgcgtgcacgccgccgacaaacggcgcgtcgccggtcgtgaagttgcgcaagcccaccggatgcccgttcccgatcaggccggcggcgatcagcagcccggccgcgatgaacgcgaccacggtcacgaccttgatcagcgagaaccagtattccgattcgccgaagccgcgcaccgacagcgtattcagcaggaagatcagcacgaggaagcccgcgccccaccagatgccgggtatggtcggaaaccagtagcgcatcacgatctgcgcggcgaccagctcgatcgcgatcgtcacggcccagctgtaccagtaggtccagccgagcgcgatgccgaagccttcgtcgacgtacttctcgccgtagatcgcaaacgaacccgaaaccggcatcagcgcggccatctcgccgaggcccgtgacgacgaagtacaccatcaacccgatcgcgatatacgcggcgatcgcaccgcccggccccgcctgcgcgaccgacgcacccgacgcgacgaacagccccgtgccgatcgagccgccgatcgcgatcatcgcgatgtggcggccctgcagacggcgcttcagcgtcgttcccgacggcgcggccgtctccactgccgcttgcatagcatccatagtgttcaccctgattggattcgggccggacaatttgattcggaatacaaatcgtcaggcccggtcattcgcgtcgaaaccggcccttcccggccggccgcatcacacgacggtgcgcttgatcgcctgcagttcggccgtcgtcacgatcttctcgatccggaatcgcgggctttccagccacacgttcgcgatccgccggtactcgtcgagatcctcgcacgcgagccgcacgagaaaatcgaacgtgccgctgacgagccagcaatcgagcacggccggattcgcacgcatctcgtcttcgaacggcgcctgcgagcgcccgtggtcggccagcacgatctgcgcgatcacgacgatcggcttggtcgcgcgcggcgccttgatcaccgcacggtagccctcgatcacgccgagcgcctcgagccgctccacgcgcgcctggcagggccgcggcgtgaggttcacgagctccgacagcttccggtaggaaatgcgcccgtcggtgcgcaggatgtcgaggatccggagatcgatcttgtcgagctgcatcttcttgtcggtcatccgcgttcgctccggtcgggtcgtggctggtgcgcggaacgtttcctgctccgcgcgggggccacattatccggccgaagcggccgcgcgccaatcggctagaaccgcagcgacaggcaggtcaggccgccgtccatcttgcggaactcgctcgtatcgatcacgtgcagcggcagcccgagcgacgcgatcgcgtcgtgcacgcgcgggtagccggccggcgtgatcagcgtgccgttcacgcgcagtgtgttgcccgcgtattcgtcggctgccgagatcgcgatccggcgatagtcggcgaatgccggatgcgcggccagcgcttcggtcacgagcagcgtgtcgtcgccgagcgcgttgacgaccgacttcagatgcaggcccgcgcccaccggcaccgcgacgaccgaatagccgtagcgcgacacgagcgattcgaacgcggcgatgccttcggcgtcggtacggcccgtcaggccgatgtagaagcgcttgccgaccagcatcacgtcgccgccgtcgagacggccgtcctgcatcggcagcaggtcgcgatgcgcggcgagcaccgtttcgatgtgcgccgtctcgcctcgccgggcaggcgcaccggggcgcgtgatcaccgcgaattccggtgtcacgaccgcgacgtcctcgacgaagtgcgaatcgggaaacgcgtccagcggcggcagttcggtcagctcgacgccgagcgtgcgcagcgcgtcgcagtatgcgtggaactgcgtgagcgtcttgtcgtagtcgggcgcgccgagcgcggcagtggtcagcccgcgccacaggacggcgcggggcggcgaacgatcgcttgcgtgaattgcatcgactcctccatggtcagcgccacacccgtgcggcacacggggcggctgcgttgtgtccggaccattatcggaagccaaattgcgcaattcgcgtcgatttcggctgcgccgacagccgattgcgtcgaattgcgcgcagcccgcagcggattcggcagacggccgttcaccgcgtggcgaacggccgctttcccgtgcgacgcgggctaagcgcccggcccgaaccccatctgcgaacggccgagcgccgagagatcgccctcccgccccgtccgtcgaattcgacctcgaaatggtcggccgggaaatcgggcgggctctcgccgcgcaggaacgcggcccgctggcgcagcaggtatgcgtcgttcttcgcgcaaccgggcgcggccgcgatgtacatcacgttgctgtcgccgctgccgcggtgcgcatcctcgaccgcgtgcacgacgtcgccatgccagaacaccgcgtcgcccggctccatgtgcgggatcggcaccagcgcatcgagcaacagtgcgtgccattcaggccggatcgacaacgctcgacccggacgcgcgccgcacaggtcgtcgtcggcgacatcgtcctgcaacgcgcgcagcacgacataggccatcgcgttcgcaaccgggatcaactgcagcgtgccgtcgcccggcccctgcggcgtgagcgcggtccagccctggaacgtacggaacatcgagcacacggccggcgacggaatctcctcgacgtccggacggaacgccgcatcgaacgggtcgtaatcgcgccagcggccggccagcacgtgacggtagacctggcggaagttcgcgccgagccagcgttcgacggaaccgccgtcgacatgcggcgacagcccgagcgacgtcgagccgggcgggcggcggcgaatccggtccgcataggccggcacctggtcgggatcgaagtgcgtacgcccgccgtcggcgtgccgccacaggcggttcaggaacacgcgcgcctgcgtcagtgccggcgactggcgcgcaaccacctgcggcttcgaccaataaacgccgtagatctgcggcttgcccgacgcaaggttgccgaaatagcgatcctcggcgcgcgcatcgagccgctcggtgaagcggttcgcgtccaggtacgcgccgatctcgtcgttccagtcgcgcgcctgccgcgcatcgaatacgcgacgaatcacgaccgcgccatgcgtgcggatcgctgccaccgcgcgcagatcgacggtcccgcccgcgatatccgcgaacggcaccaccggaatcacgtcgtgaccatgcgcatgcgcgcggcggatcgcgtcgacctgccgcgcgatgtcgccctccagctcgcggaacgtggccgcataaccgggcaggtcggcgcgcagccgctttttggcgtcgcgaatcgcggcaggcaggtcgtcaatcgtcagttgcatcgtggtctcctcgctgacaggtgtcgtgatgtgccgtcagcgtacggccggtgcgcagccgagatcaccgttatccggccaactatcgatacaatcctgacaaccctggatcactcgggacgatgacagaccacgcaaagcttgttgccgtccggatcgcggaaataggcgccgtagtaatcgcgatgatagtccggccgcaggcccggcggcccttcgcaggtgccgccgtggcgcagcgcgagcgcgtggcagcgatcgacgtgcgcgcgcgtcggcgcaacgaacgcgatcgtgtggccgttgcccggttcgggcgcgcggccgtcgagcggctggccgaagaagaacagcggccggtcggcgtcggccggcatccagcccgtccagccgtccggctcgcgaaatttcaggcgcagcccgagttccgcgaacagcggcgcgtagaaatcgtaggcgcgtgaggtgtcgctgacgcccacgcaaacatgtgaaaacatggcattgctccgtcgtgacgatcgccctcgatcatgccatggcgcgatgcccgccctctcccggaggccgcgatgaaaccgcagtacgagcacgtgacgttcgccccggctgttcgatacgcgtctaccaccgccagctcgcgcgcattccgttcgaatggcatcgccatcccgagtacgaactgacgctgacgctcaacagccgcggccggcgcttcatcggcgatcacgtcgcgcactacgcagacgacgacctggtgctcgtgccgcccaacctgccgcatacctggtcgtcgaatgcgcgcatcgatcgcgatgcgcccgaggttgcggtcgtcatctggttcgacggcgactgggtgcggcggctggccgactgctgccccgaatacgcgccgctgcgttcgctgctgcggcgtgccgcaccgggcctgcgcttcgacacggacacagcccgcgcgatgcgggcgcggctgccgcacttgctcgatccgtcgccgcgcaccaggctcgcggccgcgctcgacacgctcgccgatctcgcggaagccggcggcgagccgctcgccaccgcgcacgcgtacgaccggagcgaacgcacgacaccgcacgccgattcggccgccccgaagcggagcgcctcgaccgcgtgctcgacgcgatcgaccggcacttccacgaaccgctgcgcatcgacgcgctcgccgccgctgcgcacatgtccgaacgcacgctgcagcgcctgttcgtccggcatctcggcgaaagcgtcgggcgctacgtgcagcggctgcggctcgcgcacgcgtgccgtcatctcgtcggcaccgactggccgatcgcgaccgtggccgcgcgctgcggcattccgaatgccgcgaacttcaaccgccagttcctcgccgcacgcgggatgacgcccggcgcctaccggcagttcttcgtgcggcacggccacgcgcccgatgacgacgcgcccgcactcgacacacgcccgccgtcgctggagcatcgcgccgatccggcgcgcaatgaaaacaccccgacgggatgacccgtcggggtgtcgtggcgttgcgattgcccgacgcgagcggcctgccggccgttcgcgtcacacacggcttaacgtgcgttgagcggcttcgcttcgcgcggcgtatcgccgatgaacagctgacgcggacggccgatcttctgctccggatcgccgatcatttcgttccactgtgcgatccagccgaccgtacgtgccatcgcgaagatacacgtgaacatcgacgtcgggatgcccagcgcgcgctgaacgatgcccgagtagaagtcgacgttcgggtacagcttgcgcgacacgaagtattcgtcttccagcgcgatcttctcgagctgcatcgcgagcttgaacagcgggtcgtcgtgcaggcccagttcgttcagcacttcgtagcacgtttcgcgcatcagcttcgcacgcgggtcgtagttcttgtacacgcggtgaccgaagcccatcagcttcacgcccgaattcttgtccttcacctgcttgatgaattcggggatgttgtccggcgaaccgatctgctcgagcatgttcagcgcggcttcgttcgcaccaccgtgcgccgggcccccagacacgcgataccggccgcgatacatgcgaacgggttcgcgcccgacgagccggccaggcggacggtcgacgtcgatgcgttctgctcgtggtcggcgtgcaggatcaggatacggtcgagtgcgcggacgagcacgtcgttgaccttgtactcttcgcacgggttcgagaacatcatgtgcatgaagttcgcgctgtacgacagcgagttcttcggatacacgaacggctggccgatgctgtacttgtaagccatcgcgacgagcgtcggcagcttcgcgatcatgcggatcgccgacacttcacggtgacgcggatcgttgatgtcgagcgagtcgtggtagaacgccgacagcgcgccgactgcggcgaccaggatcgccatcgggtgcgcgtcgcggcggaagccacggaagaagaagtgcatctgctcgtgcaccatcgtgtgcttcgtgacggtgtcgacgaattccttcttctgcgctgcgttcggcagttcacccttcagcagcaggtagcagctttcgaggaagtccgcgttttgcgcgaggttgtcgatcgggtagccgcggtacagcagctcgcccttgtcgccgtcgatgtacgtgatcgccgaattacaagctgccgtcgacatgaagcccgggtcgtacgtgaacttgccggtctggccgtacagcttgcggatgtcgatcacgtccgggcccatcgtgcccttgtagatcggcatttcgacgctcggagagttgtcgctgaacgatagcgtggctttaacatcagacggagtcatggcacatcctcaatcgaaataaagaaacgggattcgataacgggcacaacgtgtcacaccttggcgttacacgttgcgcagcatctccaacagccggtgaatgtccgggctgtctaggtcgccttctggttccttgcgcgcgaggagcaagtccatcaggtcgttgtcgctcagatcgagcaggcgcgacaacgcgcctacgtctgcatcggtgaggtcatgctcgtatctgccgaagaaacgctcgaatacgatgtcgttttccagcagacccgccgcgcgcgccagcgaaggcgcgcgcgacggtgcgggtcggattgatgcgaatcgtcgctcattgcagcccggccttaaaccgcgcggcggaccatcagttccttgatcttgccgatcgccttcgtcgggttcaggcccttcgggcaaacgtcgacgcagttcatgatcgtgtggcaacggaacagacggtacgggtcttccagattgtcgagacgctcgccggtagcggtgtcgcggctgtccgcgatgaagcggtaagcctgcagcaggccggccgggccgacgaacttgtccgggttccaccagaagctcgggcacgacgtcgagcagctcgcgcacagaatgcactcgtacacgccgtcgagctcgtcgcgttcttccggcgactggaggcgttccttctccggcggcggcgcgtcgttgatcaggtacggcttgatcgagtggtactggttgaagaagtgcgtcatatcgacgatcaggtcgcgcacgacgggcaggcccggcagcggacgcagcacgatcttctgcggcaggtcgttcaggttcgtcaggcacgcgagaccgttcttgccgttgatgttcatcgcgtccgaaccgcacacgccttcacggcacgaacggcggaacgacagcgtctcgtccagtgccttcagcttcaccagtgcgtcgagcagcatgcgctcatgctggatctcgagctcgtacgtctgcatgcgcggcgctgcgtccttgtccggatcgtagcggtagacttcaaaaatgcgttttgccatttcggattcctttgactcggcttagaacgtgcgcggcttcggcggcacggagtcgaccgtcagcggcttcatttgaaccggcttgtagtcgaggcgatcgccttcgctgtaccacagcgtgtggcgcagccagttctcgtcgtcgcggtgttcgtagtcgctgtgtgcgtgcgcgccacggctttccttgcgcgcttccgccgacaccatcgtggcgcgggccacttcgatcaggttctccagctcgagcgcttcgacgcgcgcggtgttgaacaccttcgacttgtccttcaggtggatgttttccacgcgcgccttcaggccggccatctggtcgacgccttccttcagcagctccgacgtgcggaacacgcctgcgtgcttctgcatcgtcgaacggatgtcgttcgcgacgtcctgcgtgtattcgcccgaggtcgacttgtccagcttcgccaggcgcgccagcgagaattcgcctgcatcggccggcagcggcttgtgctccttctggttcttcacgtgttcgacgatgtggttgccggccgcacggccgaacaccacgaggtccagcagcgagttcgtgccgaggcggttcgcgccgtgcacagacacgcacgagcattcgcccactgcgtagaagccgttgaccggatccttgtgaccgcgcgacgtgccgacgacctggccgtggatgttggtcgggatgccgcccatctggtagtggatcgtcgggacgaccgggatcggttccttgatcgcgtcgacgttcgcgaacttcagcgcgatttcgcggatcgacggcagacgcttcatgatcgtctcggcgccgatgtgcgacaggtcgagcagcacgtgatccttgttcggacccacgccgcggccttccttgatttcctggtccatcgaacgcgacacgaagtcacgcggcgccagatccttcagcgtcggtgcatagcgctccatgaagcgctcgccgttcgcgttgcgcaggataccgccttcgccacgcacgccttcggtgatcagcacgcccgcgccggccacgccggtcgggtggaactgccagaactccatgtcctgcagcgcgatgcccgaacgcgcagccatgccgaggccgtcgccggtgttgatgaacgcgttggtcgatgccgcgaagatccggcctgcgccgcccgtcgcgaacagcgtcgtcttgccttccatgatgtagacgtcgcccgtctccatctcgagggccgtcacgccgagcacgtcgccgtccgcgtcgcggatcaggtcgagcgccatccattcgacgaagaactgcgtcttcgcttcgacgttctgctggtacagcgtgtgcagcagcgcgtgaccggtacggtcggcggccgcgcatgcgcgctggaccggcttctcgccgtagttcgcggtgtggccgccgaacgggcgctggtagatcgtgccgtccgcgttgcggtcgaacggcatgccgaagtgctcgagttcgtacacgacgttcggcgcttcacggcacatgaactcgatcgcgtcctggtcgccgagccagtcggagcccttgatcgtgtcgtagaagtggaagtgccagttgtcttcgctcatgttgccgagcgacgcaccgataccgccctgcgcggccaccgtgtgcgaacgcgtcgggaacaccttcgacagcacgccgaccgacaggcccgcgcgcgacagttgcagcgctgcgcgcaagccggagccgcccgcgccgacgatcacgacgtcaaacttgcggcgcgggagattagttttgattgcagccattctttacactctccagagaatctgcgcggcgtagcccgcacatgcgagcagccagacgatggtcagcgattgcagcagcaggcgcacaccgacgggcttcacgtagtccatccagatgtcgcgcacgccgacccatgcgtggtagaagagggaaagcagcatcacgaaggtcgcgagcttcatccattgcgcggcgaagatcgatgcccagccttcgtacgagaaatcgtgcgcgccgaagaacaggacgagcagaatgaccgtgtagaccgccatgatcgtggcggtgatgcgctgcgcaagccagtcgcgcaggccgtaatgtgcgccgacgacgaggcgcttcgagccgattcggttattggctgccattttcttagaatgctccgaacagtttgagtgccatggcgatcgtcagggcgatcgagacgacaaagacgacgactgccgtccgcttgccgccttccttcgtgacggcgtcgtggttgacgtccatcagcaggtggcgaatgccggcgcagaaatggtggaagaaggcccacgacagtgcgaggacgatcagcttgacgatgatgttggagaggaaagccttgaagacttcgaagctgagctcggacgtgaggctctggtcgaagaggaacagcaggaacggcaggaacaagaacagcagcgcgccgctgactcgatggagaatcgacaatatcgccgccagcggcatgcgatatttcatcgtgatatcggcgaatccgatgttccggtattccggcctcggctttcttactgcatcagtcatgctagacccctactatgttgtcacactaatccgcgattttagcgcctttttatatcgcgctgcagcgaaagtctgctctggatagttgcgcgaactagaacaaaggcggcccgaaacgtgcttcgcgagcgtgggaaacgcgaacgcactcggcttgagccgaaactccgtcaactcaagtcattctgatagtagtacccggttgtgacataccagccgcgacgcacctccaccggccggtcaccatatgtataggacacgcgctcgaccgacagcaacggaaaacccgccggcacgtgcagcaggtccgccaccgccggctccgccgccaccgcgcggatcttctccgtcgcgcggatcatccgcgtgccgaactccgtctcgaacatcgcgtagagcggccccttgtactcgctcagccgctcgaacgtgagcccgcggaacatcgcgcccggcagccagatctcgtcgagcaccgtcacttcgttctcgaactccagcagccggcgcacctgcacgaccggatcggccggcttcaggtcgagctgccgcgcgatctcggccggcgcgcgcaggcgccggcattcgagcaggcggctcacgtgcggatgttcggcaccgtcgtcggccagcaggcgcaggaagcggaactgcgcgcgatcttcattgtgcgtcgcaacaaaagtacccttgccctgccgccggaccacgaggttttccgcggccagttcgtcgatcgccttgcggacggtgccctggctgaccttgtagcgggccgcaagctccacctcgctcgggatgatctcgcccggcttccattcaccggattcgagactttgcgtgatcaatgacttaatctgctggtataacgggctgaacgtcggcgacggcggcgccgcaggcgaaggtgcgggatcgctcgcgcccggctgccctgggccgcctgcgccggtctgattcgcggtattcgcctggttcgatgtcatggcgcgcatttcatcacaaaccgcactttttcgtccactcaatttccgcaaaacatctgtcttatataagacatatgataccgtttgactttgcgcgtgacggctcctacactcccggtcgagcaagggttcgcgggtgcaaaagcgcgtccccggctacgtgccacggccgtctccaggttcaccgcgtctgccatcgcgagtcctccgccctgcttcaatgcaacgctacgcacaacgcgcatagaatggcgttttcgctagcgtccaacgcttcacccgtcctggagattttcaatggctaagcccgcaaagcgcgttgccgtcaccggcgccgcaggtcaaatcgcttactccctgctgttccgcatcgcgaacggcgacctgctcggcaaggaccagccggtcatcctgcaactgctcgacctcccgcaagcccaagccgccgtcaaaggcgtcgtgatggaactcgacgattgcgcgttcccgctgctggcgggcgtcgtgatcaccgacgatccgaaggtcgcattcaaggatgccgacgtcgcactgctggtcggcgcacgtccgcgctcgaagggcatggagcgcaaggacctgctgtcggcgaacgccgaaatcttcacggttcagggcgctgcgctgaacgaagtcgccagccgtgacgtgaaggtgctggtcgtcggcaacccggcgaacacgaacgcctacatcgcgatgaagtcggcgccggatctgccgaagaagaacttcacggcgatgctgcgcctcgaccacaaccgcgcgctgtcgcagctcgcagcgaagtcgggcaagccggtcgcatcgatcgagaagctcgccgtgtggggcaaccactcgccgacgatgtaccccgacttccgcttcgcgaccgccgaaggcgaatcgctgctgaagctgatcaacgacgacgtatggaaccgcgacacgttcatcccgaccgtcggcaagcgcggcgcggcgatcatcgaagcgcgcggcctgtcgtcggcggcgtcggcagccaacgcggcgatcgaccacgtgcgtgactgggtcctcggcacgaacggcaagtgggtcacgatgggcatcccgtcggacggctcgtacggcatccccgaagacatcatctacggcgtgccggtcgtgtgcgaaaacggcgagtacaagcgcatcgaaggcctggaaatcgacgcattctcgcgcgagaagatggacggcacgctggccgagctgctcgaagagcgcgatggcgttgcccacctgctgaagaactaagcatcacgtgcctttgccaggcggctctcaggccgcccggttccggcccgggccggcgccagccgccggcccggccgaacgatcggatccgcgcccgttttgccgccccgcgcccgcgcgcacgggcccagaacgcgcccgaatccgattttctccacgttgacccgcttccctgacgtagacgagatggccgcgctcactcctgcacaagtgctgtacgacggggcgtccccgcccgcgatcctgccctgttgcgatcactacgcgggcagcgaaagctgatgcgcaagtcgctcgcgctgcaggccgaaacgggccccgtgttcgacatcacgctcgactgcgaagacggcgcggccgtcggccaggaagccgcgcacgcggcactcgtcgccgacatgctcggcagcgacgaaaaccgcttcggccgcgtcggcgtccgcatccacgacttttcccatccgcactggcgcgacgacgtgcgcatcgtgctgcgcgcgtcgcgcgccccgcctacatcacgctcccgaaaatcgcgagtgccgccgacgcagccgaaatgaccgcgttcatcgaaggcacgcgtcgcgagctcggcatcgcgcagccgatcccggtcgacgtgctggtcgagacgcacggcgcgctcgcgcaggcggccgccctcgccgcgctgccgacggtcggcacgctgagcttcgggctgatggatttcgtctccgcgcaccatggtgcgattcccgatgccgcgatgcgctcgcccggccagttcgagcacccgctcgtgcgccgcgcgaagctggaaatcgccgcggcctgccacgcgcacggcaagacgccgtcgcacaacgtgacgaccgaggtgcgcgacatgagcgtcgtcgccgccgatgcacgccgcgcgcgcgacgaattcgccttcacgcggatgtggagcatccaccccgcgcagatccgcccgatcgtcgacgcattcgcgccgcgtaccgacgaggtcgcgctggccgccgagatcctgctggccgcgcaggccgccgactggggccgacgcgccacggtgatacgctgcacgatcgcgcgagctaccggtattactggtcggtgctgcgccgcgcgcgggccaccggccagcccgtaccggccgaggccgcgccgctgttcggcccggccgccgcgggcagcgcgccgtaagcgcgcggcgccggccgatacacgagtttcatgcattcgacgacacgcgaaccgaatagaggtttgcgaaacgacaaaaacgtaacggagcccgaaaacctgatatgtacgcggccaaataggtgaaaatagcggccgctgcgcgcggggcgcgtgcagtttcaaaccggccggcgattcgattgccggcccttgtcaactgattatcgaaaggttctgactccatgaagaaactcctgatcgctaccgccatcggcgccttgtccgccacgatgctggtgtcggctccgagcgcgtttgcccagggtacgaccaccacgaccgcgaagaaggcaacggccaagcgcccggcgccggccaagcgcatcatcccgcgcagcaagaaggcacaggcacgcgccgcagccaaggtcgatccggtaccggacggcgcggtcaagtggtcctgcaaggaaggtctgtcgttcgacctcgccggcgacatgaagcgcgaccaggtggtcacggttcactgggcgaagaagaactacaagctgccgcgtcaggccacgacgacgggcgcggacacgttctacgatccggcagcaggcttcaagctgatcgtgatcccgaccaaggcgatgctgttctccgacgcaaacggcggcgagcgcctcgcggacgaatgcgtgacgccggaaatggcacaaggcacgcctgcaccgacgcagtcgaacgagctgaagccggcaacgaactaagcgcgttcccatcggcccctcgatgtccgccccggtctccaacgtccgccctgctccggatacggtactcgtcgatatcgtcgactacgtgctgaataccggcatcgacagcgcgctcgcgctggagacggcgcgtcattgcctgatcgacacgctcggatgcggactcgaggcgctgtcctaccctgcctgcaccaagctgctcggccccgtcgtgcccggcacgatcgtgccgaacggcgcgaaggtgcccggcacgtccttccagctcgatcccgtccaggccgcgttcggcatcggcgcgatgatccgctggctggacttcaacgacacctggctcgccgccgaatggggccatccgtccgacaatctcggcggcatcctggcgacggccgactggctctcccgcacggccgtcgcggccggcaggaagccgctcacgatgcgcgacgtgctggtcgcgatgatccaggcccacgagatccagggctgcctcgcactcgagaattcgttcaatgcggtcgggctcgaccacgtgctgctcgtgaaggtcgcatcgacggccgtcgtcggccggctgctcgggctcacgcgcgacgagctgatcaacgcggtgtccaacgcgttcgtcgacggccaggcgctgcgcacctaccgccacgcgccgaacacgggctcgcgcaaatcatgggcggccggcgacgcgacctcccgcgcggtgcgcctcgcgctgatcgcgaaaacgggtgaaatgggctacccgtcggcactcaccgccaagacctggggcttctacgacgtgctgttcgacggcaagccgttccgcttccagcgcccgtacggcacgtacgtgatggaaaacgtgctgttcaagatcgcgttccctgccgaattccacgcgcagacggccgccgaggccgcgctgcagctgcatgcgcagctcgccgcgggccgcaccaccgacgacatcagccggatcacgattcgcacgcatgcggccgcgatccgcatcatcgacaagcagggcccgctcgccaatccggccgaccgcgaccactgcatccagtacatggtcgccgtgccgctgctgttcggccggctgaccgcggccgattacgaagactcggccgccgccgatccccgcatcgacgcgctgcgcgcgaaaacggtctgcgtcgaggatccgcagttcacgaaggattaccacgacccggacaagcgctcgatcgcgaatgcactgacgatcgagttcacggacgggtcgaagcttgccgaggtggcggtcgagtacccgctcggccatcggcggcggcgtgcggaaggcatcccgctcctggtcgagaagttcaggaccaaccttgcccgccgcttcccggcaaagcagcaacaagcgattctcgacgtgtcgctggaccaggcaaagctcgaagcgatgccggtcgatgagtacgtcgacttgtatgtgatatagccgtcagatacaggactgtttgtttcctagccttaaacccaggaaaatcaccatggcccacaatctccacaagaccctcaaggaattcgacagcggttccggcaaaggcaagttctactcgctgccgcagctcggcaaggaactgaagacgaagatcgaacgcctgccggtgtcgatccgtatcgtgctcgagtccgtgctgcgcaactacgacggcaagaagatcaccgaagagcacatcgagcagctcgcgaactggaagccgaccgcgaagcgcgtcgacgagattccgttcgtggtgtcgcgcgtcgtgctgcaggacttcacgggcgtgccgctgctcgcggacatcgcggccatgcgcggcgtcgcggagcgtacgggcaagaacccgaagaagatcgagccgctggttccggtcgatctcgtcgtcgaccactcggtccagatcgactacttccgccagaaggacgcgctcgacctgaacatgaaactggaattccagcgcaacaacgagcgctaccagttcatgaagtggggcatgcaggcattcgacacgttcaaggtcgtgccgccgggcgtcggcatcgtccaccaggtgaacctcgaatacctggcgcgcggcgtgcacaagaaggccgacggcgcggacaccgtgtactacccggacaccctcgtcggcacggacagccacacgacgatgatcaacggcatcggcgtggtcggctggggcgtgggcggcatcgaggcggaagccggcatgctcggccagccggtgtacttcctgacgccggacgtcgtcggcgtcgagctgaagggcaagctgcgcgaaggcgtgacggctaccgacctggtgctgacgatcaccgaaatgctgcgcaaggagaaggtcgtcggcaagttcgtcgaattcttcggcgaaggcacgaagtcgctgtcgctgccggatcgcgcaacgatcggcaacatggcgccggaatacggcgcgacgatgggcttcttcccggtcgacgaaaagacgatcgactacttcgaaggcacgggccgcacgaaggcggaaatcgccgcgttcgaaaactacttcaaggcgcagaagctgttcgggatcccgaaggccggcgacatcgactacacgaaggtcgtgacgctggatctgacgacggtcgccccgtcgctggccggcccgaagcgcccgcaggaccgcatcgagatcggcaacgtcaagtcgacgttcaccgacctgttctcgaagccggtcgcggaaaacggcttcgcgaagaaggcggacgacctgggcacgcagtacacgacgagcaacggcgtcgacgtgaagaacggcgacatcctgatcgccgcgatcacgtcgtgcacgaacacgtcgaacccgagcgtgctgctggccgccggcctgctcgcgaagaaggcggtcgaggccggcctcacggtcgacccgaagatcaagacctcgctcgcgccgggatcgcgcatcgtcaccgagtacctgacgaagacgggcctgctgccctacctgtcgaagctcggtttcgaagtcgcggcgtatggctgcacgacctgtatcggcaacgcgggcgacctgacgccggagctgaacgaagcgatcacgaagaacgacatcgtcgcggcagccgtgctgtcgggcaaccgtaacttcgaagcgcgtatccacccgaacatccgcgcgaacttcctcgcgtcgccgccgctcgtcgtcgcgtacgcgatcgccggcaacatcacgcgcgacctgatgaccgagccggtcggcaagggcaagggcggccgcgacatctacctcggcgacatctggccgacgagcgacgaaatccacgcgctgctcaagttcgcgctcgatccgaagaagttcgaggacaactactcgaagctgaccaagaagggcgacctctggagcaagatcgagggcgagtccggccaggtctacgactggccgaagtcgacctacatcgccgagccgccgttcttcggcaacgacttctcgatggaaccggctgcgtcgatcccgacggtcaagggcgcgcgcgcactgggcatcttcggtgactcggtcacgaccgaccacatcagcccggcaggctcgatcaaggaagactcgccggcgggcaagtggctgaaggaaaacggcgtgcagaaggccgacttcaacagctacggctcgcgccgcggcaaccacgacgtgatgatgcgcggtacgttcgcgaacgtccggatcaagaacctgatgatcccggcgaaggcggacggcacgcgcgtcgaaggcggcctgacgatccaccagccgagcggcgaacagcagtcgatctacgacgcggcgatgcagtacgtcgcggccgacacgccgaccgtcgtgttcgcgggcgaagaatacggcacgggctcgtcgcgcgactgggccgcgaagggcacgcagctgctcggcgtgaaggccgtgatcgcacgcagcttcgagcgtatccaccgctcgaacctggtcggcatgggcgtgctgccgctgcagttcaagggctcggacagcgtccagtcgctcggcatcaccggcgacgagacgttcgacatcgaaggcctcggcgacgacttcaagccgcagcaggacgtcacgctcgtgatcaaccgcaagaacggcgaaacgcagcgcgtgcaggtcctgctgcgcatcgatacgccgatcgaagtcgactactacaagcacggcggtatcctgccgttcgtgctgcgctcgctgctcgcagcgtaagcgccctgcctttgcaggtgccgcagccgcctcgcggcggttgcggccgatttggatgcccgacctcgtgtcgggcttttgcctgcgcacgacgcggcgtgaccggccgcgtcgtgcgtcacgccgccttgtcggcccgcgccttcgtgccctcgcccgcgcgccgcgtgttcttcttcaggtgcgtgcggttgtactcgatcgccgcgcgcacgagattcttcagcgcccgcttgtcgagccggtcgccttcgaacaggtcgatcgcgcgtcgcgcattgccgtcgaggccgtcgttgaacagcttgtcgggatcgggcaactgcgcgccgtgcatgaaggtcagcttcaccttgcccttgtgcgcgtttgccaccgcgatcatcccgtcgcacgaccatacggggctgcccatccacttccattcctcgacgatgcccgcttgcgcggcgaggatcgtctggcgcaggtcggcgaaggtcttgccgcgccagtcggcgatgccggcgatcagcgcgtcgatgcgctccgacggcgtgaggtccgttgcgttcatgcgcgggcctccgtgccttcgtcggggcgtgccagcacctgttcgagcgcatcgaggaaccgcacccagccgtgctgcgcaccgcggtatgcctgctcctggtccgtgcggaagccgacctgctccatccgcaggtgcgtgccggccggcgtcggcgtgagcgtccacgtgacgacgctttcgaggccgtacgcggcccacgtataggacagcgtgcgcggcggctcgatcgtcaggaccttgcagtcgaccgagccccagtcggcgcggaagctgaaggcgcggcccgcgacgggttcgaagtcgctcttcatcagccacgcctcgatcaggtgcggttgcgtgagcgcgcgccagatcttctccggtggatgaggcagttcccggtcgacgacgacggagcgcgtttcggtggtggcctggttcattactggtccatccttttcagaagatcttcgagggcatcgaaccggttctgccagaagccggccatctggctcgtccagtcgatcagcggggccagcgcttgcggctgcgcgctgtagtgcgtctgccggccttcgtgacggtcgttcacgagcccggcctgcttcagtacgccgagatgcttcgacacggccggctgcgagacgcccgcatgggccgtcagcgcggcgaccgtcagctcgccgtccgcgcacagccgctcgaagagcgcgcggcgggtgggatcggccagcgtccggaaaagcatgtcgtgatcggtctgcatgtcgttcaaaattcataacccgttggttatggattgaagaatagccgccggtcgacgcgcgtcaaggcggaatttcacgaacggcgtcgtgcaatccggtgcgggcctgccgcccacccatcggcgcgcgcctgcgcccggattcgagcgtttcctctaatccgcatgggcgacacgcgatccgaaagccgcctgcaagactgcccgacgtgctgttccacagttcgggaaacgtttgcgttcgaccggcccctttcttgtgcacgtgcgaatccgttcctgccgcatcgcttcgtttgaccacatagtgcgacgcggcatgcggcaacgaccggtcgcgcgccacgcgttcacgcatcgatccactccgcgatcgcgcatgttccgacgccgtgacgagcgactcgtgcgtgcgaacgtcacgcattgccgcgccgtcgtgccgcgaaccggttccgttcgccacgcccacgatcgtctgcgcatacgacgcagcgcgtgcacgctcacaccccgatgtcagaactgacagctatggaaactggcagctacctgaacggtagcgacgccctacgctcgtcaccgctcgcgaccccacaagggtcgagggctccagcaacgtcgtctctcctaaaaggactcccgatgaaaaggaacgcctggtttgccctgcccctgccgtcgccccgccgccttgcgtgcgtggcaccttgtgttcgctgccgctgcggcgcatgcggcgacggactgggtcgatacccatacgaaagcctttctgaccggcccgcagttgatggcgcgcagtgcggcaccgtcgctcgaactcgcggccggcgaaacgaccgacgtcgtcgtcagcctgaagctgcgcaatgccgcgcagctcaagcaactggcgcgcgacgtgaaccggcccggcagcgcgcattaccgccagtacctcacgcacgagcagttcctcgcccactacgcgccgaccgatgcgcaggtgaagtcggtcgtcgactatctgcacaagagcggcttcgtgaacgtcgaggtcgcaccgaaccggttgctggtgtccgcacgcggcacggccggcaccgtgaagaccgcattcaacacgtcgctcgtgcacttcgactacgcgggccgctcgggcttcgccaacacgtcgaccgcgcaggtgccgcgcgcgctcggcgacgtcgtcggctcggtgctcgggctgcagagcgtcgcacacgcgcggccgctgctgcgcatcggcaacgtgtcgaagccgcaggcgctcgcggccggcacggcgaccggccactatccgaaggaattcccgggcctctacaacgcgaccggcgtgccgaccgcagccggtgtcaccgtcggcatcatcacgatcggcggagtgtcgcagacgctgcaggacctgaagcagttcacgtcgagcaacggttacggcacggtctcgacgcagaccgtcaagaccaacggctccggcggcagctacaccgacgaccaggacggccagggcgaatgggatctcgacagccagtcgatcgtcggctcggccggcggccaggtcggcaagctcgtgttctacatggcggacctcaacgccagcggcaacacggggctcacgcaggcgttcaaccgcgcggtgtcggacaacaccgcgaaggtgatcaacgtgtcgctcggctggtgcgaaaccgacgcaaacgcggacggcacgctcgatgccgaggaacagatcttcacgacggcagcggcgcaaggccagaccttctcggtgtcgtcgggcgacgaaggtgtgtacgagtgcaacaaccgcggctatccggacggctcgaactacacggtatcgtggccggcttcgtcgccgcacgtgctcgcgatcggcggcacgacgctctacacgacgtcgtcgggtgcgttctcgaacgagacggtgtggaacgaagggctcgacgacaacggcaagctgtgggcaacgggcggcggcgtcagcacgatcctgcccgcaccgtcgtggcagtcgggcagcaaccgccagttgccggacgtgtcgttcgacgccgcgcaaagcaccggcgcgtacatctacaactacggccagctgcagcagatcggcggcacgagcctcgccgcgccgatcttcacgggcctctgggcacgcctgctcgcagcgaacggcacgggcctcggcttcccggccggcaatttctatgcggacattccgtcgcgtccgtcgctcgtgcgctacgacgtggtgtcggggaacaacggctatcaggggtatggctataacgcaggcaccggctgggattacccgaccggcttcggcagcctgaacatcgcgaacctcaaccagctgatcaagtcgggcgggttctaagcgaagcctgaaggccggtgcgcggcggcaggttgccgcgcgccggcgcgtgccttgcccttgcctattccgccgcccgctcgcccacgcgctcggacgccgccgccacgccggcccgatgcgacggcgcaaagagccgcaacccgctcgcgacactcgccgccccggcgaaccccgcgccgagcatcagcgcaagcgtcggcccgtggcgccccgcgatcccgaacgacagcgcgacgagcgcagcaccggtcgcctgcccgatcagccgcgcggtcgcgatgatcccgctcgcgccgccgctgcgctcgggcggcgcgctcgacatcagcgccttcaggttcggcgactggaaaaaccgaagcccgcgccgcagagcatcatccgccagccgatgtcgatcacgcccggcgccgccggcaacgcggcgagcgacaccatgcccgcgctcagcaacgcaagaccgatcgcgccgagcaggcccggcggataacgatccgacaaccgccccgcgatcggcgcggcaagcgcgacgatcgccgaccacggcgtcatcaggaaccccgtctcgaccgcgttgcgatgcaggacggtttcgaaatagaacggcagcgacacgaacgcgagcccctgcgcggcgaacgcgcacacggcggtcagcgcggacagcgtgaacaccggccggcgaaacaggtcgaccggcagcatcggtgccgggtgcccggcctggcggcgaatcagcagccagccgaacgcaagcgcgaccgcggccgacgcgaatacgatcgaaagcggcccgcgctgcgcgaattcgccgagcgcgaagatcagcgacgcgaacgtgatcacgttgaacaatgcggcgaccggatcgaatgcatgcttgccgcgcgccgtctgcggcagcgacggaatcgccacggccagcgcgaacacgccgagcggcacgttcaccgcgaacagccacggccacgcggcgaccgacaggatcagcgacgcgatggtcggccccaccgcgaacgacacgccgacgacgagcgcgttgaagccgacgccgcgcccgagccggtgcgcggggaacaggccgcggatcagcgcaacgttgacgctcatgatcgcgctcgcgccgaagccctgcacgatccgcgcggccgtcagcatcggcagcgtcgacgcgagcgagcagccgagcgacgcgagcgtgaacaccgcgagcccggcgatatacacgcgcttgtggccgacgatgtcgccgagcgacgcgaacggcagcagcgtcgcgaccatcgcgagctggtatgcgttgatgatccatacggacgcggccggcgatgcatgcaggtcggcggcgatcgcgggcagcgcggtgttcgcgatcgcggtgtcgagcgtcgcgagcgcgacggccagcagcacggcggacatcgcgcgccagttgacggccggctcatgcgcgccggcggaggaggcgaattcggacaagatgaggctcggctgacgagcgacgcgttgcgccgcgtcgcggattggactcgcggcggcgttccggtcgcaccgcacggaacgcgcgccgccgcgtcccgtattgttgcagagccgcatcgaacgtgcaggcggccgcttcgtcagtcagcgaaatgaaagcaatgcgcggccacgcatgacacgtggcgactcaggtgccggggcaagcccgcccgctcagctcaccgcgcgccgcgcattgcgtccgcgcagccattcgagcgcaagcagcaggctcgtcgagaagatgatcaggatcgtggcgagcgcggcgatcgtcgggctgatgttctcacggatgcccgtgaacatctggcgcggcagcgtggtctggtccgcgcccgcgaggaacagcgtgacgacgacttcgtcgaacgacgtcgcgaacgcgaacagcgcgcccgacatcacgcccggtgcgatcaccggcagcgtcacgcggaagaaagtcgacaccggattcgcgccgagcgacaggctcgcgcgcacgaggttctggttgaagccctgcagcgtcgccgcgaccgtcgtcacgacgaacggcacgccaagcgccgcgtgcgcggcgatcagccccgtgtaggtgttcgcgagcccgagcggcgcgaagaacaggtacatgccgacgccgaccacgacgacgggcacgatcatcggcgacagcagcacggccatcagcagccccttgccgcggaagtcggccttcgtgagaccgatcgcggcgagcgtgccgagcactgtcgcgacgacggtcgccgacggcgcgacgatgaagctgttcttcgcggccatccgccactcgtccgacgcgatcaggttctcgtaccagcgcatcgagaagcccggaatcggatagacgaggaacgtgctcgacgaaaacgacagcggcacgatcgcgagcaccggcaggatcaggtacagcagcgtcagcacgacgagcacgcgcagcgcgacgtaccacgcgcgctcgacgaacgacatgtgcggcgcgaacagcggcctggcgagtttcatggtcggattccccttcccgtttcgttgtgcgcggcgctcagccgaggctcacgttcgtgcgcgtgaagcgcccgtacaccgcgtacagcacgagcgtcgccgcgagcagcagcccgccgagcgcgcacgccatgccccagttgatcgtcacgttcgtgaagtacgcgacgtaatagctgaccatctggtcgttcggcccgccgagcagcgcgggcgtgatgtagtagccgatcgcgaggataaacacgagcagcgcgcccgcgccgacgcccggataggtctgcggcacgtacacgcgccagaacgcggcgaacggatggctgccgagcgatacggccgcgcgctggtaggtcggcgggatcgacttcatcacgctgtagagcggcaggatcatgaacggcagcaggatgtgcgtcatcgagatatacacgccgatgcgattgaacagcagcgtcagcgggtgcgagatcagcccgctgccgatcagcgccgtgttgatgagcccttcgctctgcagcagcacgatccacgcggcgacgcgcacgagcaccgacgtccagaacggaatcagcacaaggatcatcacgaggttggcacgccgctccgacagcgtcgagatccagtacgcgagcggatagccgagcagcagcgcgaacagcgtgacggcgacgccgatcacgaacgtgcggccgaagatcgccagatagatcgactggtccggatcggcctgcacgatgtggccgaagccgtcctgcttgtggtcgagcgcggcgagcaggtagaacggcgacacggtgctgccgttcttcgcgatcgactgccagtacgcgacgtcgccccagcgcgcatcgaggtcgatcagtttcgcgcgcgtctgcgcgggcgtcagtgccgcgtcgttgtcgcctttcagcggcatcgcgcgcgccgtcttcgcgacgagcgagcgatagccgggaatctcggtgttcaggcgccgcgcgagcgcacccatcgcctcgctgtcggccaccttcgtcatgtcggccgcgagcgcgacatacgcggcgtcggccggcggtgccttgcggtcccagcccgacagcgcggcgaccgtgcccggcaacgcagtcgcgatctccgggttctgcaccgcgcgcgtgagcagcgtgccgatcggcacgacgaaaatcagcagcaggaaaatcgcgagcggggcgaccagcaacagcgccatcgtgcgcttgcgggcttcggcggccttcagctcgcgcttgagcgcggcggtcgacggcgaggaagacgcgatcgtcatcgtattcaacgtttctctccggccggggacgatccggcggaaggccgcgcgacgcgatcgacgcgccgcgcggcaggttgcatcaggacacctttgaggatgcctgaccggttacttcgtcgcccatgcggcgaaacgctgctcgagctcgtcgctgtggtcggtccagaagccgatatcttccagcacggcgttcttgccgttggccggcgagttcggcaggttcgcgagcgtcttcgcgtcgagcgacttgatcgccgcgatgttcgcggggccgtacgcgatgtgctgcgcatacccttgctgcggcttcggcgtcagcgtgtacgcgatgtactgctccgccagcgccttgttcggcgagcccttcggaatcgcccagtagtcgaggtcgtagatgctgccgttccacacgaccttcaggttcttgccttccttctgcgcggcgtcgatgcggccgttgtacgcggtcgacatcacgacgtcgccggcgacgaggaactgcggcggctgcgcacccgcttcccaccactggatatacggcttcagctcgtcgagcttcttgaacgcgcggtcctggccggccttcgcgccgagcaccttgtagacgtccttcggcgcgacgccgtcggccatcagcgcgaattcgaggttgtagcgcgccccttgcgcatgccgcgcttgccggggaatttcttcacgttccagaaatcggcccagccggtcggggccgacttcagcttgtccgcgttgtacgacagcgccgtcgaccacacgaagaagccgacgccgcacacctgcggcgactccggaatcaggtcggacttcttcgcgatcttcgaccagtcgagcttctcgtacagcccttcgtcgcagccgcgattcaggtcgcccgactcgacttcgaccacgtcccagttgacgtgcttcgcctcgaccatcgccttcactttcgcctgctcgccgttgtattcgacggcggtgaccttgttgccggtcgccttctcgaacggctggttgaacgcggccttctgcgcgtcgccgttcgcgccgccgaagttgacgaccgtgagttcggcagccgatgccgatacgccgacgacggcgagcgcgagtgccagcgcggtacgacgcgcggtaatgcttgctcggttcatggtggttcctctcctctcgtggtggaagtgggcagttgttgttgacgacgtacagcggaaaatcgggaaaaccctgctcaagcgaacacgcgcaggtgttcgggtgcgaacgcgagcgcgaccggtgcgccgggcgagaacgcatcgagcgcgccggtaccgagcggcaccttcacgaagcactcgtcctggcccggcagcgcgcagcgcatgcgcacgtgatcgccgaaatagatgaggctgcgcgcctcgccgctcaaccggttggcggccgcgccgttcgcgtgcccgttcgcgccgtgcggggcgaggctcatgcgttcggggcggatgcacgcgacggccggcgcgccctcggccgcatcgccgatgcggcggccgacgagctgcgtgccgtcgtcgagccggaattcgcagaattcgccgtcgacgcgcgcgatggtgccgcgcagccggttgctgtcgccgatgaagttcgcgacgaattcgttgcaaggcgactcgtacaggcggtcgacggtgtcgagctgctgcacgatgcccttgtcgaacacggcgacgcgatcggacatcgtcagcgcctcgccctggtcgtgcgtcacgtacacgaaggtcacgccgagcttttcgtgcagggccttcagttcgtactgcatgtgctcgcgcagctgcttgtcgagcgcgccgagcggctcgtccatcagcaccagcttcggctcgaacacgagcgcgcgcgccagcgcgatgcgctgctgctggccgcccgacagttgcgccgggtaacgtttcgcgaagcgctccatctgcaccatcttcagcgcatgcgcgacgcgttctacacgctcggcggccggcagcttgcgcacggtcagcggatacgcgacgttctgctcgaccgtcaggtgcggaaacagcgcgtagttctggaacaccatgccgatgttgcgcttgtgcggcggcacgttgttcagcagttcgccgtcgaggcggatctcgccgccggtcgggaattcgaagccggccagcatcatcaggcaggtcgtcttgccggagcccgagggcccgagcagcgtcaggaattccccgcggtggatatcgaggtcgagcgatttgacgaccagcgtttcgccgtcgtaggtcttccgcacgccgcgaaagctgacgatcacatcatcggacttcatcgtggctgtccccttgcttcgcgacaattgattttgagatgcgagccactatacggcgcccacggttctacaatagggaaccatttcaatattactagtaggaccactttggataccgtgatcctcgccgactggctctccgcccgtctcgaccgtagctcgcccgagccgatgtaccggcagttgctgcagctgatgcagcaggccatcctgaccggagaattggggccaggaaccaagctgccgagttcccgcacgctcgcggccgacctgtcgatcgcgcgcaataccgtgctgcacgtgtacgaccagctgaccgccgaaggctacgtactgacgaccaccggcagcggcacctatgtggccgacacgcggccggatgccgccgcgatccacgtgccgggcgccgcgccgccgccgtcgagcgccgatgcggcgccgcagccggacgcgcagggcggcctgtcgatgcgcggccggcaactgatcgagcatgcggggtatcgcgacgccaatggggcgcgttcatgccgggcgtgccggacgtgtcggagttcccgagccggacgtggagccgcctgcaggcgcggctgtggaaggaagcgaaccccgagctgctgacctatgcgccgggcggcggctaccggccgttgcggcgcgcgctcgccgattacctgcgcgtcgcgcgctcggtcaagtgctcgccggatcaggtgatcatcacgacgggcatccaccagtcgatcgatctcgcggtgcggctgctgtccgacatcggcgatcgcgcgtgggtcgaggaaccgtgctactggggtgtgcgaagcgtattgcaggcggcgggcctcacgctgacgccggtgccggtcgaccaggaagggctcgacccgcgtgccagcgacatgcagcatccgccccggctcgtgctcgtcacgccgtcgcaccagtacccgctcgggatggtgatgagcctcgcacggcgccggatgctgctcgaatacgcgcgacagcaccgctgctggatcatcgaggacgactacgacagcgagttccgctacggcagccgtccgctcgcgtcgctgcaggggctcgacgacggcggccgcgtgatctacgtcggcagcctcggcaagatgctgtttccggggctgcggatgggctacatggtcgtgcccgagcatctcgtcgacacgttccgcaccgggttgtcggagctgtaccgcgagggccagttgatgcagcaggccgtgctcgccgaattcatcatggacggccacctgacttcgcacgtcagacggatgcgcacgctgtacggcgagcgccggcagctgatgatcgacgcgatccgcgcgcgcttcggcgacgcgctgcccgtgatgggcgacgaggccggcctgcatctcgtgctcggcctgcccgacgcctgcgacgaccgcgcggtcacgcagagcgcgttcgatgcgggcgtgatcgtgcgcccgctcaccagctactacagcaacctcgataccgcgcggcgcggcctgttgctcggttatgcatgcgtcgcgcacgaaggcatccggccggcattcgacacgctcgcgaataccatcgagcaacacctgcctcgcgatctcacccgcgcggcataacgaccgtcatgcgccgtgccgcccgcgccgcgagcgttaccgcgcgctgcccgccccgcgatcgagcgatgccgcgcgcacggcttcgccgggcttcgtgaacacgcgctgccgcagcgcggcgatctgcgcgtcgcgatcctgcggcgacaggccggccgactcgatctgcgcacgctgcgccgcatagtccgcgtagcggctctgccacgatgcgtcgtcctgctgcatctgcgcgacgcgcgcggccgcttcggggccgagcgtctgcgtcagttgtgcgcgcatcgcatcgggcgtcgccccgctcttctgcaattgcgcgatctggtcgatcgccgcgcgctgccggtcgacgcgctgctgcgcggcgcgttcgtcggccggcatctgctgttcgagcgccgcgagccgttcggccttctgcgcatccgtcagcgcggggtcctgcgcgatcttcagccgcgcgaggtcgtagcgctgccgccattgctccgcaccgaagaacggctggctccagtcgccgagcgtgcggtacgcgatcgacgcgcgctggtcgagcgcgagctgcaatgcacccaggtccgacttgtcgaccgcgccggcatcgtgcaatttcgcgagtgcgtcgagatacgcgcgataccggtgccacacgtcgagcgcctcggcctgcgcaacggtcccgtcgagctgtgcggcaatctcgcgcacgacgaatgcatcgagcccggcctcactcaggtcgctctgcgcggtcaggcagtagtcgaagaaatcccgcaccgcgcgcgccttcgcgagatggccgccggcatcgagcggcaagcgaggcgcgctggagccggcgagcgacggcggcaggcccgtgcttgccggcacggcggcctgcggcggtgcggcagccggtccgcgtgccgccgacgcatccggcggctcgccggatgcgtccgtcccgccatgccggcccgcgccgctccacatcgccacgccggcaatcgccgccagccccacggcaccatagaccacggcgcggcgcgccagcggcgcgcgtcctcctcgtgccgtcatcgattacacgcccgccagcttcagccggttcgcatgcgtgcggatcaccgcgaccggatcttccgcatacgcgccgcgcacgccgagcagctggttgatctcgtcgaggtggttccacttgtagttcgtgctcagcaccttgccgtacagcgcactgcacttcgacacgagcccgtcgttctgcccggagccgcggttgatcatcaccgtgccggtgccgaacagcgcgagcgtcgacaggtcgagcacgttcgccggatcgacgagcggaagggtgctcgtgtccgtcgcgcccgtgacgccgaacacggaaagcgtcggctggatcgccgtgccggcccacgaatacagcaggtgcgtgttgccgccgacggtttcggtcggcgcaccggtctggcaactgcccggcgcacccaggcccgcgctcggatagttctggttgtacgtagcggcccgtgcggtggtcagcgtctgcagtgcggcgagcgcgtcctggttggtgttgtggctgctgctcgtcaggatcccgaacacattgacgaacgcggcgatcaccgatgacgaaagcccggtcggatcgtacgcgagcacgttctgcacgaagtcggcgaattcagagccgcgatgcggcgtgccgatcgtcgtcaccgacgcaacgagatcgggcgcgacggcggcaacatagcgcgacgaaaggccgccctggctgtgaccgacgagattgaccttggtcgcccccgtcgccgcgagcaccgtcttcacgtaagcgagcaactgttcgccgcgcccgttcgggccgtcgtcgctctggaaacccgacaggttcgcgacgtagacggtcgcaccgttctgttgcaggtcctcctggatgccgtaccaatactcgagcacgccggcgtacttgtcggtacccgagagcccgtgcacgaggatgatcgggtaacgcgtcgccgcgtagccagcggcgggcgcggtggccgccattgccgcgtgcgtcgtcgcgagcgtcatcaccgcggtcgtccccgcgaacggcgcgatgctcatcgcgcatgccactgcccctgccaccaccctggaacgcatcgtcctggccatgcatgttctcctgattattgtgctgccggtgcgaatgaagccggatcgacacacaccctgcatcgcgaacgtcgcgcgcaccgtgtgcgtcgaatgcgggagtgaatcacgactcgtgaacgtttgcgccctgactagacacggttctctaatcggttgacgcgccccgcccgttcaggcggggccgcgttcatgcgtgcgcatgctgcaacgcacacgcacgacgcgttacagcttcgcgctcacgcgcacccaggcggtccggcccggctccatcaccggcgagttcgccggatagccgaagcccgcgttgccggcgaggttcaggtgctcggtataggccttgttcagcacgttgtcgacgcccaccgatacctgcacggtcttgctcacgttgtactgcgtatgcaacgagagcacaccgaatccggcgctcgggccgaagtccttgccgaccacgttgccctcgttcagtgcgtagcgatgctgcggcgcaacgacgcgccacaggccccctgccgaccatgcaccacgcgtgtattcgagcccgatgcgtgcctcgagcggcggcatctgcggcagcggatcgccgcttgccacgttgcgcccccacgcatacgcgagcgacgtctcgacgcgcagcggcgcaaccggccgccacgacacgcccgcctcgccgcccatgatctgcgcattgacgttggtcgcctgcgtggtcgggcccatcatgccggccgaatagttgaacaggatgaagtcctgcacgtagcccgcgtaggccgacacccatgcatcgagccggtcgctcttgtattgcgcgccgatgtcgagctgcgtggtcttctccggctgcaccgccgaaaacgcgttgaccgaaccggccggcccgcgcttcgcggagaacagctcccagtaatcgggataacgctccgtatggccgatccccgcgtaccacgtgacgggcagcgacgcgagatcgcgttcgtagcggatgaagccgctcggcagcacgcgcgtgcgatcgtcgtcgaaggtcggattcggcttgctcttcatcatgccgctcgtcgtcgcgcgcttgtcgcgtgcgctcgcatagtcgacgcgcacgccgccgatcacgcgcgacacttcgctcgcgtaccacgtcagttcgccgaacacgcccgcgttccacatcgtcgcctgcgcatcccacggctggtcgccgtagttctgccgccccatcgccgagcgcgagtcgagccggttcgattgcgcatccacgcccgtcacgagcttgaagtcgccggcgaaacggaacgtcgcggctgcacgcgcgccgaccgtgcgacgccgcacttccgacgccatccgcatcggcatgctgctggtcgggtcgggttgccgcaacgtgtagttgtccatcacgtgatcggcttcgttgtagtacacgcgcgcctcgatccggtcgagcacgtcgccgatatgcttcttgtcgaacgacaggccgaacgtctcgcggcggaaatgcgcgccgtccattccgcgccccgcgtagcgcgcataaccgtcgccggtgccggcggtcagctcgacgcgcgtgtggtcgtccggtgtccagccgagcgccgcatcggcattccatttgtcccactgcgacggcacggtgttgccgttgccgtccttgtagtcctgcgaatgcgcgtggttcgcggtcacgcggccatagacatccggcgtgccggccgtcacgtcgacgttctggtcgttgcggccgaacgacccgccgaccaggctgccctcgaagcgcatgccgggcttgtcgaatcgcggggtcacgcgctcgaacagcacggtgccggccgatgcgccggggccgtacagcacggtctgcggccccttcaggacggtgaccttgtcatagctttccggtgcgatatacgacgtcggcgcatccatccggcccgggcatgcgccgagcgtcgacatccgttcgccaggatgttcagccgcgagccgaacatcccgcgcagcacgaggtcgccgttggtgccgccgctgcggatcgacgtgaagccggggatcgtcttcaggtaatccgcgccgtcgctggcgggcagcggctggcgcggggtcttcggatccgtgacgacgacgagcggcgtcgtcagcggcgatgcgacgacttcgatggccggcagcggcgcggccgtatcgtcggccggcgcgccggccgcgcgcaccgtttcggctgccgcggcgctcgcggccagtgcgccggctgcgagcgcgggaacggtgagtttcagcacgcgcggcatgcgccgcgcacaggcattgcgcgacgcccgcggcgcacgcaactggaaaatggtcatgatcgaaagcccgagtgacgccctccgcacggcctcgacgggccgcacggatatcggcggtgaaaagaacggaaaacagcgcgtcaggcgcgctcgggcggtgcgcgcgggtacgcgcgcggatagcggtcggcgcgcgccgcgacggcaggcggcgcgacggcggagacggaaacgacgggaacggaagcgagtgccgcggcggcagtcccgccgatcgcgggactgtgcgcgaagaaaccgcagtagccgcacgcatcgagatgcagcgcgtgatcgtgcatgcggcctgcatcgggtgaccgatgcgcgccatgctctgcactgcagacaattgcgtcgggcgtggccgcctgcgcgacgcgccactgcgacaccagcggcgccgcgatcgcgaaccagatcgcgagcacgccaagccaggcggtcaggtgacgatgtcggtgcagcatgcgcggcgcagagtaagcggaatgtaaaaacagccgagatgttacagaatgtttaacgcgctgaccagcgcagatggcagaaacggaccgggggcgcatggttgtcaacacaaccatgcgcccccgcctgctgcatgcttccggaacgaacgtgccgttcagggcgccatgcgccgcagtacgtcgtcgcgccggatgaaatgatggtaaagcgcggccagcgcgtgcaatccgatcacaaaatagaacgcgttgccgatcagctcgtgcgcttccttgatcgtcggccgcagcgccttgtcggggccgagcagcgtgaacgacacgccgagccagtcgagcgacaccggctttccgcccaggttgatcgtcatgatcccgagcagcggctgcgcgatgatgaacacgtagagcgcgagatgcgcgagcttcgagagccagcgcagcagcgccgtttgcggaatggcctcgggcacgcggctgacgactcgccacagcacgcgcagcaccgacagcacgagcacgagcgtgcccgcggtgaggtgcacgttcatccagaacacccggctgtcgctgcctttcgggccgcggatctcgatggccaggtaggccagcgccaccagcgcgaacacggcccagtggaagaagatcgcgggcgagctgtagcgcgtctgtttcgcgaggatgtttctcatgcttcgtctcgtgttgtatgcggggatgggcgcatgccgcaatcggctcggcagcccggcaaggctgccacgattgtagccgcacgtgcgtccggttttgtgcggcgaggtcaaatatcggatgaatcgtcaacgcacgcgccgcgcgggccgtcatatggaaaatccgcatcgcgcccgtaaacggctgtggcacgatgaagctttggtgtcgacgttgcgcgcgcatcatgagcaaggcgttcttcgttgcggcctatcggctgaccgccgcgttgctcgcggtgtcgacgacgttgcacagcatcgccggctactggggcatgcctgcattcgagctcggcaactttctcagctacttcacgcaactgagcagcctctacgcggccgcgatgctcgccgccgggctctggcgcatcgcccgccccggctcggctcgctacgaatcgatgcgcggcgccgcggtgctgtacgtcctgatcaccgcgatcgtctacgagctcctgctcgcgcggctcgatgcgctgcgccacgtcacgccggcgttcaacaactgggtgctgcaccggatcgtgccgctcgtcgtgctgtgtgactggctgtacgtggagccgcgcctgccgatcccacggcgcagcgcgttcgcgtggctcgcctttccggtcgtctatctcggctatacgctcgtgcgcggcgcgctggagaactggtatccctacccgttcgtcgatccgcggccgcatggctacctgccggtcgcgatccagtgttcgctgatcgcggtcggcgcggcggcgctcgcactgggcattcgctggctcggcaatcacgcgagacagtcgggcgcggtgacgctcgggaaaggatgaaggcgggaaacgccggaacgtgtgcgccgcccggcgcacacggggtgaggcgggccgtcagccgccgttgcgcggcaggaagttcatcggatcgacgaccttgccgttctggcgcacttcgaactcgaacgtcgaacggccgctcgtgtcggtgcccatttcggcgaccggctggccctggcgcaccgcgtcgccttcgttgaccagcagtttgccgttgtgtccgtaggccgtgatgagcccgttctcatgcttcaggatcacgagcgggccgtaggccttgacgccggaccccgcataaaccacgcgtccggccgccgcggcccgcaccgaatggtcggggccggacgcggcgatcacgatgccgcgcgtcctgccggccgcgaacggcgtcgccacgacaccggtggccggccaggcgagcgagcccggctgcgcggccgccgagggcggctgcccgagcgacgtcgccgcaggcggcggcgcgacgcgcagcacctgcccgggatacacggcatcggtcggcgccatgtggttccaactggccacgtcctgcacgcgctgcccgtacgcgttcgcgacgcccgcgagcgtatcgcccggattcacgcggtaatagccggcgatcacgcccggcgtcgcggccgacgtgggtgccgactggcgcgccggctgccagctgtcggtccacggcgtcatcgtgcaacccgtcagcgcgatggccgcggcaacgagtgccgcctgcggcagccagcgcgtcggcgcatcgtggatgggaatagtttctctcaagggtcctcccggatttgcgtcgttgcgccgcccaccgcccccggcgcgcgacgcacgatgtccggccggacggccggaccaatcagtatccgaccgctctcgcggccgtcagtttccacagcggaacatcggcgcgatgggctcaccggccctttttcgcgccgttccgatcggcaaagataccatttgtggcggtcaaggccgcgaccgatgcctgatccggcaacaatcttgcggtgccgcagcagcgtgccggccgcctgcgagccccgccgggcgggcctgccgcggatcttccgcaggcctcgccacccgcgcctgccgtatcgatcccgtcacattctccccttcgatcgccacctatactcggtgatgcactgcgcgacccaacgacaacgaggagcatgacaatgaacaacgcgacgtttctttccgtgcagctcaacgccgacgatttctccggttccagcggcctggtcgaattgctcaaccggcacctgctgttcgcgaccgacgtcgccgaggcggccgatgcgctcgtccagctggcgagcgtcgcgcacatgaccggcgccacgcgccacagcgtcgagctgccggttctcgcaatcgagcggctgcgcgacgcgctcgacacgctgagcggctatgacgaaacgtggctgcaggtgctggaaccggccgaagcgctgttccgggatatcgggcgcggcaggcgcccgctgcactgaaccgacggtcggcgcgatacgcgcgccaccaatgaaaacagcccgtcgttccgctatccggaacgacgggctgttcgtactcaggggacggatcaggccgccaacgcggccgcaccgaccgaaccaccattaacgacccttgtagatcggcgcgtcgtcagcgatgcgcttgacttgccagccggtcttggccttggccggtgcgccggattcttgcgcggcggccggttgtgcgccatagccggtcgtgtcggcagcggcaacgttctgttgcgggttcaggcgggcttcagcggcctgaatgctttccgggtagttcgtacggtcgctgcccagcttgtagccggcctgctggacggcgaccagatcggccttcacctgtgcacgggtgacgggcgcattctgttgggcgaacgagacggcgggaacggcgagaacggcagctgcggcgaacgttgcgatcagcgatttcatgattacctccgggatttttgctccgccgcacacaccatgtctgcagcgatggaacagagtttagtcccgggaacacctaggaaaaccatgaaagaacgaaaacactgtttcccgggagccaacaatgtcggcatccgggatagaaaaaccctattcaaagaatagattttcgcaacaatgccgcccccgccagccggtcaggaccagttcgcgtggaagctgcccggcttgtcggtacgctcgaacgtgtgcgcgccgaagaagtctcgctgcgcctgcacgaggttcgccggcagccgctcggaacgatagctgtcgaagtacgcaacggccgacgcgaacgccgggaccggcacgccggccttcaccgcggccaccacgacgtcgcgcagcgcggtctgatagttcgcggcgatgtccttgaagtacgggtcgagcagcaggttcgcgagcgccggatccttcgcatacgcgtccgtgatcttctgcaggaagcgcgcgcggatgatgcagccggcgcggaagatcttcgcgatcgtcccgagatcgaggttccagccgtactcttcggatgccgtgcgcagttgcgcgaagccctgcgcgtacgagatcaccttgctcaggtacagcgcgcggcgcaccgcttcgacgaacgcggcgcgatcgccgtcgaacggcgcggcggccgggcccgacaggatcttgctggccgcgacacgctcggtcttcagcgacgacagcacgcgcgcgaacaccgactcggtgatgagcggcagcggcacgccgagatccagcgcgttctggctcgtccacttgccggtgcccttctgcgcggcgcgatcgaggatcacgtcgacgaggtgcttgccggtctcttcgtccttcttgccgaagatcttcgacgtgatctcgatcaggtagctgtcgagttcgccctggttccattcggtgtacaccgcgccgagttcgtcgttggtcaggcccgcgacgtccttcagcaccgagtagctttcggcgatcagctgcatgtcgccgtattcgatgccgttgtggaccatcttcacgtagtggcccgcaccgtccgggcccatgtaggcgacgcacggctcgccgtccgacggcgccttcgcggcgatctgcttgaggatcggctcgacgaggtcgtacgcgtcacgctggccgccaggcatgatcgacgggccgcgcagcgcgcctcttcgccgcccgacacgccggtgccgatgaagtgcaggcccgattgcgcgagttcctgattgcggcggatcgtgtcggtgaaatgcgtgttgccgccgtcgatcagcacatcgcccttctcgagcagtggcttgagcgatgcgatcgtcgcatcggtcgcttcgccggccttcaccatcatcaggatccggcgcggcgtttcgagcgacgcgacgaattcctcgagcgtataggtcggcaccaggttgcggccggggaattcggcgatcagttcgtcggttttctcgcggctgcggttgtacacagacaccgcgtaaccgcggctctcgatattgagtgcgagattgcggcccatcaccgcgagcccgatcacaccgattgcttgtttgcccattagtcaattctccggaaaaacggggcgcgacccgaaccgggtcgcgcgcacaggcgaaaggatagtggaaacccggcggcgatgcgcgcttgcgtgtcactgctccgcgtgcggcagccgccggaacacgatgctcaggttgttcgccggcatctcgaccacctcgatgcaatcgagcccgcgatcgaggccgagcgcgacgacggtttcgagatcgcgcacgccccacgacgggtcgcggctgcgcagctgcaggtcgaatgcctcgttcgacggcgccgtgtgccggccctcgcggcgatacggcccgtacaggaacagcacgccgcccggccgcagcaggcgcgacgcgcccgcgaacagcgcgtcggtgcaggcccagggcgagatatggatcatgttgatgcagacgatcgcgtcgagcgcgtcgaccggccacgacgcgtcgcgcacgtcgaacgccagcggcccggcaacgttcgcgaggcccgcatgggcaacccacgcggcgatcgagcggcgcgcctgcgcatcgggatcgctcggttgccagtgcaggcccggcaacgcctgtgcgaaatggacgacatgctggcccgtgccgctcgcgatttcgagcacgcggccgctcgtcggcaacacgcggcgcaagacgtcgaggatcggcccgcgattgcgttcggctgccggcgccgacagccgcgcggacggatcgggcgaagcggtcggatcggtcacgatgcgtgctccggtgcgtggcccgcgaggcccagccgcgcggtgagcgcgtcgagcgcgggtgcgcagcgcgcctcgaccttcagcgtcaggatcggatcggcgcgcgtatggccgagattgagcgcggcgaccggcttgtgctgcgcctgcgcccacacgcagaagcggtagccggaatacaccatcagcgacgagccgacgacgagcagcgcatcggccgcatcgagcgcctgcgacgcgagcgccacgcgctcgcgcggcacgttttcgccgaagaacacgactgccggcttcagcagcccgccgcacgcggggcacgccgggatgcggaacgtgtcgagcgccgcccattcgagatgcgcgtcgccgtccgcggcaggctcggcctgcgcgcccagcagctcgggattgtcggcctcgagcatgacctggatggtcgcgcgcgcatgatgcgcgccgcaatcgagacacgtgacgccgtcgatgccgccgtgcagctcgatcacgtcgccgctgcccgcgcgctggtgcaaaccgtcgacgttctgcgtgacgagacgctcgatccgccccgcgctgccgagccgcgcgagcgcgacgtgcgacccgttcggctgcgcgcggccgacgacgggccagccgatcatgctgcgcgcccagtagcgccgccgcgcatcggagccgaggaattcatggagctgaatcggcggcgagcgcatccactggccgttgcggtcgcgatagccgggaatgccggagtcggtgctgatgcccgcgccggtcagtaccagcaggcgcggatgacgttcgacgaacgtctgcagcgcatcgagtgcggccggatcgatgccggcggttgagggtcgtgcagggctgtgtcgttcatgttggcaacgcgtgatcgggtgcgccggcaagccgtgcgcccgcacgggcagccaggcacgccagcacatgatacagaacgccgcgcgatcgggccgatggctcgcgtcgcaaaccggcgcacaaaagacgcccatccgccactcggcgatgggcgcttcaacaattgatccatcggggtagtggatcaactgacagcacaatttcgcggcgcccgccatgccgcggccggcgaacgcctccctggactgcatgtattccgcggtgccggacacatcgatgcgctgtcggctttccggtgcgctccggtgcgttccggttcgggcccgtcgcgccgacgcgatacgcggcgcacgaacacctgcgccgcgcgacgactcgcgttgcgcgcgccagcatgacgatccgggttccgggccgggccatccacggatattcgaagttcgtccccgacggccgaccggcaccagtcggcctcgtgcgtcacacctgcacgtcgtcgttcagaacaaacccgattgctcggatggaacggaaagccgcgcgctcacgtcgcctcgatcaacggcgaagcgaatacccaggcaggtcggcgattcatgtttgcaacacggcatgttgcgattcggtctgttttcattctcttgtccccgtctccgatacgtccgacccactgaagcgatcgccggaccgactgcgtccgcgaccgcgctcacggcacgtacagatatgcaaggagcgcaccatgcttcatgccgcaaggccgcgcgggccgaagcggggccatcgcggcgaatcgcgcaccggcaagcagcgcgaacgtttcgaaactgaaacgcgtgccggatcggcgaccgtcggccgggcatgccgcgatgtcgtcatgccgcgccggcacggtccgcgccgatgccgcgtcgttgcatccgcgcgcgattgccgaccggcttacaatcgccccacagtgccgcatacgcacgaacggacgcgcgggcccgccccggcctgcttcgcgcaacccgccgccacctgacgggagccacctgcccgacctatgcctgacacacacgactggctggatatcgactaccggacgctgttccggctgcatccggatcgccggatcgaacgcgagaacgatcccgactgctcgcccgggccccgcttctggctcggcagaggcgcaaaacgcaacctggcgggcgtacgcgccgacgtgccctttcctgtcgcagaaaaactggcgcgcctggccgacagcgaaacgccgtcggcggactgcacgcagcccgcgcatctcgaacgctatctgtcgctgctcgcccccgttccgcactggaacatcggcctcgtctacgcgctgccgcacgcactcggtttcgacaccgacgcacacgtcgagctgatcgatggcgacagcgacgcgggccggcatctgctgcacgcgctgtcgacacgcgggatgcccgaaggcctgttctcgatggggtttcaaggcgccgccgatctgtgggcgccgtggtgcgcggccgtcgtcgacggagaagtcgcctcggtcgcattcgccgcacggctatccgaagtcggtgccgaactcggtctcgcgacggcccctgcattccggggcgcggcctcgcggcagccgtgaccgccgcgtggtcgcggctgccgtcgcttcgaacccgcacgctgttctacagcaccgccagcgacaaccgcgcgtcacaacgcgtggcgtcacgcctggcctcacgctgcgcggcacgacgctgcgcgtggcatagcgccggggcctgcgcgacacctcaacgaaaggcctcgatgaccttgacacgacgttcggtctcgccgacgaagcaactgtcaacctccacgagcccgagcgtaccgcctgcatcgggctgccgcgattcggcgcaggcagcatcccgcgccttgagccagcggcgctcgtcgtcgcgcaacctcgccttgccctgtgcatccaggctcgccatcttcgtcttgtagacggcattcaaccgtcggtcggcctcgtcgtatttcagccgcaggcaattgcggatgtcagccgtgtagcccgtttcctcggcggtcttgcagatagcggtacgctgcgcatcgtccgcgcgcgcgccgggcgcaaccgtgaaaagcatcgcgctcgccgccagaccgatcatcgcgtgttgaagcgcattcatccggattcgctgttctcgatgattgaaggcaccgattatgcccggcccgctgcccgcatggctcccgttacctcgacgtcaccggtcacgcccgatcgggctctgcgcatgccgtgccgcgcagccggcgcgcaaacacgctagcattcggacacgcaacgtcgcacgcccgctttgccccgcctccaaggacccgacatgaccacgcccgcccctgcccgtcccgacgtcgcgcatcgcgtcttttcggccgggcagctgtcgatcggcctcacgttgccgctgcttcgcaccggccatgtcgtcgccgacttcgacgagcaactcgaactcgcggcgctggccgacacgctcggctttcgcgcgctgtggattcgcgacgtgccgctgaacagcgccgactatcccgacccggtcggccacctcgacccgtgggtcctgctcggcgcactggcgtcacgcacgcgccggattgcactcgccagcggcgcgatcgtgctgccgctgcgtcatccgctgcatatcgcgaaaggcgcgctgtcggtcgcgacgctgtcgggcggacgcttcatcctcgggctcggctccggcgaccggccgcccgaatatgcggcgttcggcgtcgacgcggaaacgcgccgcgaccggtaccgcgcgcactgggacgtcgtcgcggccgcgctcggcgtgccatcgcgcgtgctgcccgacgaagcgccgcccgatgcgcccgacttcacgctgctgcctcgcggcgccgacgcggtgccgatgctggcgatcggctcgggcggtcaaagcgtcgactggatcgcgcgtcactcgatcggctggatgacgtaccaccgcgatccggacacgcagcgcgcacggtattcgatgtggcgcgcggcggttgaaaggctcgcgtcgccggcctttcgcgcgttcggcgtgtcgatgcgactcgacctcgtcgcggatcccgatgcgccggccaccgcattgccgctcggctatgcaaccggacgccgcgcattgatcgacatcctgcggaacatgcgcgcggcaggcacgcatcacgtcacgctgaatccgggctcggaccggcccgtgcgcgacgtcatcgaagaaatcgcggaacacgtcctgccggtttttcacgacggggaagcgtgatttggcaggattccggatgaattcggcgcgatgcgcgcggcgctcgccgttgcccgcaagcgggcattacgcgagccttacacgccggcaatcgagtcgcctcccctgcgtcagccacatgaccgcggaaacgcgccgcaaacggccgcgccgcgtcgtgcatgcccgattcgaatgatcgtcgacggaactattcggttccgtgcgcgatcatgttaacttcccgtccatcgttcagcccggcgggccgcgcgccgatgcgcgcccgcatgcccactccatgcgacatatcctcctcggctggctgcttgccgccgtcgtcacggccgctcacgcggccgctcccgccccggccgccgcgtcggccgcttccggcaccgcgcccgcgctgacgccgcaacaggctcagcaggcactcaacgtgctcgaaaatccacgcgatcgcgcgcaggtcgaaacgacgctgcgtgcgatcgcggccgtcggcgcgctgagcgcacccgcggtcgttgccagcgatgcggcggcggccagcggcgcttcggcggccgcggccccgggcgcgctcacgtcgaacgggctcgcgtcgatgctcgtccggcagggatcgcgctgggccaccgaaatcggcggcgcgctgaaggagtcgctgcactcgctgctcgatgtcggctcggtcggaagctggtggcacgacaggctggtgcgagccgacgagcgcgcggatctcgcgcacgcgttctggatcatcgtcgccgtgctcgtgcccgcgctcttcgtcgaatggttggcaaagcggttgttgcgacgcgcgctggccgcagtggccgcacggcgtgccgacacgtcgccccgcaccgcgccggactccgccacgcccgatgacgacgacgcgccgccggacaccctcgccaaacccgactccgccgatcccgccgatgcccctgacaccgcccccgcatcgtcacaaggccgaggccacgcgcgccgccacaccacgctgctgcaccggatgccgcgcgcgctcgtcagcctcgcgttgcgtgccgtgccgctgctcgtgttcgtcggcgtcgcgagcctgacgatgtccgcgatcggagagacgggcaccccgatcgaatccgcgctcgaagcgctgatcgacatctacgtgatctgccggctcgtcacgatcgtcagccggctgttcttccagcccgatgcgcggcaattgcggttgctgcacatcagcgatgcgtgggccgatttcgcgcaacgttcgatcgcgcggatcgtgatcgtggtcggcgcctgcacggccgctgtcgagatcgccgcgagcttcgggctcagcgaggccggtcatgtcgccctgctgaaagccgtcgcgctcgtcgggcacctgatggtgtcggcgctgatcttgcggagccgccagccggtcgccgcgcggatccgcgcggccggcgacgaccgtgcgtccttcgagatggtcgcgaatgcactcgcggacgcatgggcccccgtgtcggtattcatcgtgatggcactgtggttcgtgtgggcgctcgacgtccacaacggctatcgcgtgctgatcacgctcggcggccgctcgatcgccgtgatgatcggcatgcggatggtctcgatcgtcgtgttcggcgcgctcgcgcggctgttccagggccgcgacgaagaccgcacgctcgtccacctgcacgcgtaccgctactacccgctgctgcgccagatcgtgtcgggcgcgatcggcatcgtgaccgtcgtgttgctgcagatctgggggtgccgatcttccgcgcgttcgaaaccggcaccatcggccaccggctcgcgtcggcgctggtgacgatcgcgatcgcggccatcgtcgcgctcctcgtgtgggaagccgcgaacatcgcgatcgagcgccgcctgcagcggtggacgcgcgaaggcaatctcgtacgcgcggcgcgactgcgcacgttgctgccgatgttgcgctcgctgctgttcgtgatgatcgcgctcgtcgtcgtgctgacgggcctcagccagctcggcgtgaacgtcggcccgctgcttgccggcgcgagcatcttcggtgtcgcgctcggcttcggctcgcagaagctcgtgcaggatttcatcaccgggatcttcctgctgatggaaaacgcgatgcaggtcggcgactgggtcacgctcgccggcgtgtcgggtacggtcgagtacctgtcgatccgcaccgtgcggctacgcgcgggcgacgggtcgctgtacacgatcccgttcagctcggtgacgaccgtcaacaacacgaaccgcgggctcggcaacgccgccgtcaagatcagtattgcctacggcgaggatatcgatcgcgcgatcgcgacgctgaaggagatcggcgcggcgttgcgcgacgatccgaaataccgcgacggcatcctgtcggacttcagctactggggatcgaccaggtcgacggcgcgacactcgcgctggccgggcagatgcaatgcacggacgcgacgcgctggagcgtgcagcgtgaattcaaccggcgaatcgcggagacgttccgcgaacgcggcatccggatcgccaatccgcagcgcagcgtcgtcgcctatgcggacggatcgcggcctgtcgtcgaaggcgaaaacggcggcaatggcagcgacggtgacaacagcggcaacggccatgctgcagaaccggcggcccggccgccgtcgcccgccgaaccggagcgcaagccgggttgaccggccggggcgatgccgcgccgcgctcaacgcgcggcgggcttgttcacgcgccgcgtgcttttcgcgccgggcgccgatgcccccgccttcgccttgaccgcacgtttcgccgccgcgccctgcccgcgcttcgcgccggcttccggatcggcagccgatacgtcgcgctgcgcatgccattgctcgagcagcaggcgtgtctggtcggcgatcgtgtcgaccagcaatgccgcgcgctcgccctcgaacgcctcccattcgagcaactgcagcgccgaacgctgcgcgatgtggaacaccgtgatctgcccgaacaggctcagcgcgcgcaatcgggtgacgggatcgttggccggccggcccgagatacggccgatcagttcggcgctcacgtcgttgagcggcttgcgcatgcgcttcatcaggatctcgctcgcgctcgccggctcctggccgccttgctcgcgtgcaaagaacatccgctggttcatcgtcttcggcgcggtgaacatccggtccgacagcgcgcgcagcagcccgatgaacgcgtcgatcagcacgtcgacatccgcgtccgcatcgagcatcgccctcgcatggccgaccgacggtgcgaacacttccctgccattctccgcgatcgcctcgacgcacgcgcggtacacgccctccttgttctcgaagtagtactggagcgccggcgcgttcacgccggccatcgcggcgatctcgcgtgtcgatgcacccgcgaacccgcgctcgccgaacagttcgatcgccgcctcgatgatccgctggcgcgtttcgtcgccgcgggcgtagccgcccgccgacgtccggcgcagcttcttcgcttcgttcatgccttccccgtcattcgatcgatcgatattctacttgacacaattttatcaactggaataattcttccacttggaataaattggacaccggaatgtcgacgccgcaagacccgccacagcaagcagatcgtcaggaaaacggaacaacaccgcgaaacggaagcaaatccggaaacggatcgaaacggcgcatcctgctcgttgtcgccgtgctcgcggcgatcggcggcgccgtctggctcggccgctggtggacggtcggccgtttcatcgaaagtaccaacgacgcgtacctgcaggcggacagcatgactgccgcgccgaaggtcgccggctacgtgaccgatgtgtatgtccgcgacaaccaggccgtgaaggccggcgatccgctcgtgcgactcgacgtccgccagtaccaggttgcgctcgcgcaatcgcttgcgaccgtcgatgcacgccgcgcggatatcgcacgcgccgaggccgacatcagccagcagcgtgcgaatctcgaacaggccgacgcgcaggcgaaggtgtcgcggatcaatgcgcagcacgccggcgacgaatacgcgcgttatgcgccgctcgcggcgaccggtgcggagacgcacgaacgtgtgacagacctgaagagcacgcgcgatcaggcggtcgcgacgctcgccgcgaacaatgcgtcgatcgcggccgcacgcacgcagatcgcgtcgttcaccgcccagctccagcaggcgcgcgcgcagctcgaagccgcgcaggccagtgccgcgcaggcccagctcgacctcgacaacacgatcgtgcgcagcaccctcgccggccgcgtcggcgatcgcacggtgcgcgtcggtcaatacgtgcagcccggcacgcgcctgctgaccgtggtgcccgtcgattcgatctacctcgtcgcgaacttcaaggaaacgcagatcggcaacatgcgtatcggccagccggtcgaactgcatgtcgacgccttgccggacggtgcgctgtccggcgtcgtcgacagcttcgcacccggcaccggcgcgcagttcgccctcctgccgcccgagaatgcgaccggcaacttcacgaagatcgtccagcgcgtgccggtgcgcatccgcctcgccgcgaacgcccgcgcgcagcgcatgctgctgccggggctgtcggtgacggtcgacgtcgatacgcgctcggcccgcgacgagacgcatcatggctgaaccgtccgccacgatgcccgcgccgccgcatgaaggccgcgcgagcgtgaccgactggatcgcggtcgcggccggcgcgctcggcgcgctgatggcgacgctcgacatctcgatcacgaattccgcgctgccgcagatccagggtgaaatcggcgcaaccggcaccgaaggcacgtggatctcgaccggctacctgatgtcggagatcgtgatgatcccgctcgccgcgtggctcacgcgcgtgttcgggctgcgcaatttcctgctgacgaattccgcgctgttcatcgcgttctcgatgatgtgcggctggtcgcattcgctgccgatgatgatcgccggccggatcggccagggcttcaccggtggcgcgctgatcccgaccgcgcagaccatcatccgcacgcggctgccgctgtcgcagttgccggtcggcatgacgctgttcggcctgatcgtgctgctcgggccgctgttcggcccggtgctcggcggctggctcgcggaaaacgtgaactggagctggtgctttttcctgaacctgccggtgtgcctgctgttgatggggctgctgtggttcgggctgccgtccgaccgtccgcaatggagcacgttcttcaacgcggactggctcgggatcgccggcctcgcgatcgggctgagctcgctcaccgtcgtgctcgaggaaggccagcgcgaacgctggttcgaatcgcagatgatcgtcacattgagcctggtgtcgctcgccgggatgatcctgatcgcgctgtcgcaacgcttagcgaagcggccgatcgtgcggctgtcgctgatgcgcaacccacgctacgcgagcgtgatcgtgatcgtgtccgcggtcggtgccggcctgtacggcgtgtcctacctgctgccgcagttcctcgcgatcgtcgccggctacaacgcggaacaggcgggcgcaatcatgctgctgtcggggctgccggcctttctcgtgatgccgatcctgccgcgcctgctcggcaaggtcgatttccgcatcctcgtgatctccgggctgctgctgttctgcctgagctgcatgctcgacatcagcctgaccgcgcagagcgtcggccacgacttcgtctggtcgcaactgattcgcggtgtcgcgcagatgctcgcgatgatgccgctcaaccaggcatcgatggcggccgtcgcacgcgaagactccggcgatgcagccgggctctacaacatggcacgcaacctcggcggctcgatcgggctcgcgatcatcggcaccgtgatcgaccggcgcacgaccttccacacggccgcgctgcgcgaatcggtgacggcgaactcgctgatcgggcaggaccggctgtcggcctacgcggccaactggttcgcacacaccggcgatctcgcgtattcgaacatgcgcgcgctcggacagctggcgcagcagatccaggtccaggccgtcgtgatgacctattccgaaaccttctatctgctgggccttgcactgctcgcctgcgtgccgctcgcgctgctgctgagaacgccacgcgggccgcagccgatgtcgtccggccactgaaccgtcttacgcgatgaaacccttctccctgccccgccgccccgtgctcacgctgtgtgcggccgcgtgcctgctcgccggctgcacggtcggccccgactaccgcggcgcgcccgccgcaccggatgcgccggtcttcgtgcgcgcgccggcctccggtgtcgacaccaccgcacccgcgccaagcgcgtggtggcacacgctcaacgatcgccagctcgacgacctgatcactgcggcgctcgcgtacaaccccgatctgcacgctgcgcaggcacgcttgcgcgcatcgcgcgcgcagctcgcaacagcgcgcggcgcagctgccgaaatcgtccgccaccgtcgccgccatccgcatgcgcgagccagacgtcagcgcgctcggttcgctgctgccgtcgaacggctcgaaccagtcgggcggtgcatcgccgtcgctgggcggctcgggtccgctgcagctctattcggcaggcttcgacgcaacctgggaagtcgacctgttcggcggcacgcgccgggcggtcgaagccgcttccgctcaagcggaagcagtcgacgccgatctcgccgacacgcaggtgtcgatcgcggcagaagtcgcgaacgcgtatgtcgacctccgcgaccagcagcagcggcttgcgctgtcgcgacgcaccgccgagctgcagcagaagatgctcgaactcacgcagcagcgccgcgcgcgcggcgtcgcggccgatgccgacatcgaacgcctgacgacacaggtcgagaacacgcgagcctcgctgatcccgctcgacgcgcaggtgacggaatcgctcgaccggctcgcgatcctgacggggcgcgcgccgggtgcgctcgacgcgacgctgacgacaccggccgcgccgctgccgacgctgcccggcagcgtcgcgatcggcgatccggccacgctgctgaaacagcgccccgacattcgcgcggccgagcgccggctcgcatcgagcaatgcgcagatcggcgagcatgtcgccgattacttcccgaaggtgacgctgctcggcgatctcggcttcagcgcggcggacccgggccacctgctccgcaagcagaacttcacgtgggtcggcgcgccgtatctgcaatggaacattctcgacttcgggcgcacgcgtggcgcggtgcgcgcggccgaagcatcgcgcgacgaagcggaagcgaactatcagaaggcggtgctcggtgcgttgcaggacgccaacacggcattgcagcgctacggacaccagcgtgagcacgtcgttgcgctcaccaaggttcaaacctccgccgtgcattcgcgatcgctgatggatgaacgctatcgcgcgggcgtcgcatcgatgatcgacctgctcgatacgcaacgcgaagcactttccgcgcagcagaacgtaatcgccgggcaggccgaactgatcaaggactacgtgtcggtgcagaagagcctcgggctcgggtggcaggcgggtgcgggttgatggtgagtcgagcagtgccgtacgggcgggtttgtcgcggctgcaacgcatcgacaacagcgatgcgcgggacagaaaaacgtttcgcgcgccgcccgtgaccacccgatgaatcagaaaactcgtcgagcagccggtagaaagcgatccggcccggatcgggctgcccgactccgtaccggtcgaagaaaggcgcgacccattcactgacgagatcggcttcgatatctcgcatcggtgattcgagtcgcgcctcgaatacggtcgacgcagtcgcgccaattacgcatcgaaccggaaacgatcggcgaaccgcattcagcattactttcttcgttggcgtcgaatattacaaattactgccaaaattttcaaaaatattgcatttattcgctttaaatttgtttcatataaccaaaaaagtttgacaccccgctttcgttcttgataccgtccgatgcaagcaatctgacaaattgctcactgcgcaatcgcttccgctccacgtttttcgcttccgccgcaccgaagtgccagccgccggccgtatcgcgcgccggccatgcaacatcccgatgcatttcattggacgactgccatccggcagcgggccgaaggatcgaatcaaatgagcaggacaacgaaactgttgctctagcaatcccgcccgcgcccagtccgcgcgactgcgccgtatcgcgacgcagctctctcgctaccgcattttccgaatttcgccccggagaaaaacacctttccggatcgggcgaaaggccctgtcgcgtccgcgccatccgcacgcatgcgacagaaaccggcggtgcatgatccgcgccgctgtcgaccgttgttgttcgtgccgttcgatgttcaaccggaggggtaattcaaatgaatcaggttgcagacaagaatcaaaagcacaatcgcttcatcaagctcgccttcgccgccgcggcagccgcatcgttcggcatcgcgaccgtccacgccgcgcccgcggccggctggacggaaacgcgcaccaagggcttcctgccgctcgtgcagcagagcgaagccggtacggccggcgcgcctgccgcaagcacggccgccgctgccacggcagccatcgagatggcacccggcgaatcggtggacatcgtgctcgggctgaacctgcgcaacgaagcacagctcgaccaatacctgcacgacctgcatacgcccggctcgccgcactaccggcagttcctcacgccggcgcagttcgccgcgcaatatgcgccgaccgaccagcaggtcgcctcggtcgtcgcgcacctgcgcaaggaaggcttcgtgaacatcgtggtcgcaccgaaccgcctgctggtatccgcgtccggcaccgcggcgaccatcaagtccgcgttccgcacgacgctcaagcgcttcacgcgcaacggacgcagcgtctatgcgaataccgacgccgcgcaagtgccgaacgcgatcggcggcgtcgtgggcgcggtgctgggcctgcagaacgtcgaactgatgcacacgggcgcgggcggcaagccgcaaggcaacaccagcaacctgacgattccggccggcgcatcggcggtgccgcacaacccgaccgagttctcgtcgatctacggcggcaacggtacgccgacggcctcgcaaaccaccgtcggcatcatctccgaaggcgacctgtcgcagacggtgagcgacctcaacacgttcgccgcaaacaacagcctcggcacgatcagcagcagcatcgtgaagacgggcccgtccggcagctcgtacaccgacaccgacggcaccgtcgaatggaacctcgacagccagtcgatcgtcggcgcggccggcggcagcgtgaagcaggtcgtgttctacgtcgcaccgtcgatgacgctcacggcgatcaccgccgcatacaacaaggccgtgaccgacaatgtcgcgaaggtaatcaacgtgtcgctcggcgtgtgcgaatcgtccgcgaacagcaccggctcgcaggcaaccgacgacaccatcttcaagcaggcgatcgcgcaggggcaaaccttctcggtatccgccggcgaccacggtgcatacgaatgcgcgggtggcacgccgtcgcgctcgacctacacggtgagcgagccggcaacgtcgccgtacgtgatcgcagtgggcggcacgacgcttttcaccaatacgtcgaccaacgcttacaacagcgagatcgtctggaacgatccgagctggcagccgggcaccgtgtggtcgacgggcggcgggtacagcaagtacgaagccgcgccgtcgtggcaatcgtcgagcctcacgggatcgaccaaacgcgcgctgcccgacgtcggcttcgatgccgacctgcgcaccggcgcgattctcgtcgtgaacggccagacctccgacacgctgtggggctcgggctacctgaacaacgaaggcggcacgagcctcgccgcgccgatcttcacgggcatctgggcacggctgcagtccgctaacaacaatgcgctcgggttcccgcgtcgagcctctacaagtacttcccgagcaacgcggcgctgctgcacgatgtcacgtccggcaacaacggcagcggcacctacggctacaaggcgaaggccggctgggacgcgacgacgggcttcggcagcgtgaacatctcgaagctgaacgcgttcatccagagcacgccggatttcgcacgctgatggaccgatgaccgccccggttccgcgtgtgctccgaggcgcacgcatggaaccggatgcggtcgttcaaatcacccgcgatgaccgccaggccgtcgcgggtttttgcgtttcgcgcgatctcgcggagcagcagccggtgcgacgacgcactcgccggcctttcaatcgttgcgcaagcgactttaacgtccaatacccgtgcatgagcatcgcaccgagtgaaacgcaccccgtcacggcagcgcggtattcgcgctgcctgccgacgaaacgcgcgtcgtgccgccatgcgacgcgagcacgactcaaacgccgtaccccgccgtcttccacgaagccgcgcggccttgccgcacaactcactcagcccagttccggacgtagtccggcaccggcatgttgccgtcgacatgaaccggtgcgccgcgcgtcgtcttcagcggcaggatccccgtccagacagcaagcgcaagatcttcatccttgtcggaaggcagcgaatcgctgactttcaccgccgcttccgcaagggcaatccgcagcacgctggtcgcattgatttccttctcgttgccgggccgcgcgtcatgcttgcgaccgggtgcgatcttgtccatcaacgcatccagcgccgccagcttgtcgtcacggccctccacgacgtcgaaccgcccgtagatcaccgcggatcgataattcatcgaatggttgaaggccgacctggccagcacgagcccgtccagcaacgtaatcgcgacggaggccggcgcgcccgccgacagcgccttgatcatccggctaccgttggaaccgtgaatatagaggtcatcgccccgtctccagtgcgctgtcgggatgcagtgcgtgtcctcgcctgcagcgaacgcgatgtggcagacgtacgcttcgtccacgatgcgatgaagcatcgtgcgatcgcgattcgccaattccggcaggcggcgaatggtggtgcggggtgtggaagcgatgacggtctggtctttcatgtttcgttttcctgttcgcgcgcccttgcgcacatcgagaggcccgcgttccggcaaggctcaacgatccgcccggaatatatttgtactgcgaatttaatcgaattgaacgcgtgcagcttccaagcctgcaaaccggtcgatcggcccatcgacagccgcgcttcaaatcgatcaaaatacgcgcgtgccgcaatcggggacgatcgccggaagaccccgcgcaccggccggcaccgcgagaacgtgaacgatacgatgcgcgccgaatcttcaaaagaaccagctcaacgaaaattctggaaccagcccatggatctcgcgctgctcctctcatcgctttccagacaggaaggcgcgacgcgccacagccagcaggaagccctctaccggagcctgcgcaacatgctgctggacgggcacatcccgtccggcacacggctcgtgtcgacccgcgtgctcgcggcggaattgggcatcgcgcgcaattcggccgtctatgcgtacgagcgacttgccgaggaaggcttcgtggcggccacgcgcaacggtacgatcacgcgctgggacggatgcggctgttcgagcaccgggctcgagagcgggccggccacggttcgcttgtccgagcgcgtgcacgggctggagaacgccgatcccgaacccgaacgcatgctgccgttcgtccccggtcttccgtcgctcgatgaattcccggttgcccaatggcgccgttgcatcgagcgcgcatggaaagtcatcaagcccgcgcagctcgcatacggtccggtcgaagggctgcccgaattgcggcgtgccgtggcggcctacatccgcgtctcgcgaggcgtgcgctgcgaaacaggccaggtattcatcaccgacggcacgcaaggcagcctcgaactgtgcgcgcgcatgctggcgaatcccggcgaacccggctggctcgagaacccctgctacaacggcgcccgtaccgcattccgctcgaccggcctcgatatcgtgccgatcgaggtcgaccgcgaaggaatggcgcccaccgacgaacagtggcgcacccggccaccccgactgatctatacgacgccatcgcatcaatacccgctcggcgcgctgatgagccccggcgacgagcggcgctcgtcgagcacgcacgtgcgtgcggcgcgtggatcatcgaggacgactacgacagcgagttccgccacgacggcgagccgctgcccgcgatccagggcctgcatgccgacgcaccggtctgctatctcggcaccttcagcaagacgatgtttcccgcccttcggctcggcttcatggtggttccgccggttctggtcgaacgcttcacccggacgctgcgcgaactcgttcatcgcggccactcggccgatcaactcgcgatggccgagttcatcgacacgggcctctttgcgcggcacctgcgcaagatgaggacgctgtatgccgagcggcggaacaacctggaaacggcactcgcccgccacctcggcaccgcgctgagcgttcgggaaagcccgggcggcatgcatctgtcggcggacctcgcgctcccgctgcgcgatacctacgtcgcccgcgccgcagccgcgcgtggcctgctgcttcagccgctgagcagctaccgggtcggcgacggccggccgtacaacggcctcgtgctgggatactccgggctgagcgatgcgacgatcgagaccgcgacgatgcagctcgcggccgtcatcgacgcgcagggccgcacgcgcggctgagcgtcacacgcggcatcgtcgcctacagttgcgactccagcggaaacagcccgagaaaccagacttccatccgccgcccggccgacacttccggttcgtgatcgagctcggtgaccttcccgttcgaatcggtctgaatccacttgagctgccccttgcccgccgcatcggtcctcggctcgacgcgccacgcgattagatcgagccgcgcttccagatcgttcgccacctgcgacgcaatcgccgggctctcgcagtaaacgccgatctccgtattgaggttcagcgaacgtggatcgagattcatcgatccgatgaaaatgctcttgtggtcgaacacgtaggtcttcgcatgcagcgacgcacgtgacgatccgatgatgacctgcttcgagatgctcttgtcgcccgacggccgccgttcgtaaagccgcacgccggctgccacgagatcgctccggtaatgccggtagcccgcatgcacggccgccacgtcggtcgacgcgagcgagttggtcagcaccgtgacgcgcacgccgcgcgccgtgagcgcgcgcagccgctcgacgacatccttgcccggcacgaaatacggcgacacgatcagcaggtcatgttcgggctgcaacgcgagcgcccgcaattgcggcatcaaatgcccgtcgctgtccttcggcgcgtgcgcgatcttcgacggatcgtcgtacagcaccgttgcgcggccccacgacagttccgtgccctgcccgtgaacgatgcggtcgagtcgctgcctggcctcgagcacgtacggattgtcctccatggccctcaggtagtcgcgcaaccgttcgcgctcgcggtccagcccgcccggtgccgcctcgtgcccgaccagtgcgctgatcggatacgcgtacggggaattccagaacgtgtcgaattcggtcgagatgtccttcacgaccgggccatggacgacgacatcgagatcgccgaactccagcatcgacgatgcgccgaaatactcgtcgccgatattgcggccgccgatgatcgccgcctggttgtccgcgatcatcgccttgttgtgcatgcgccggttgacacgcgcgaactcgaacaccgtgccgatcttcttgaaccgccgcgtggcgaccggattgaacagccggatctcgatgttcgggtgcgaactgatctcgagcagcttgcggtcgtccgcgttcgtgccgagatcgtcgagcagcgcacggacgcggacgccgcgatccgccgcgcgaatgattgcgtcggcgagttcgtggccggtcaggtcgtcgtgccagatgtagtactgaaggtccagcgagcgatcggcgcggtcggcgagcaacacgcgcgcatccagcgcgtcgaccggatcggtcagcaggtgaaacgcgtcctgcccgggatgggcgctggcttgctgccggaacgctacgcccagccgcgtgttgtccgtatcggtgtatgcgtgcgtcggcgcgcgatcggcctgcggcggcaggctcgcgcatgcgacgagcgccagcaacgaaagaatcgcaccccacgaacgcagcatggtcatgattgccgtcccgctcccggtcgaagtctgtttgttctcgccgccggatggatcgcggggctgcctggttttcgttcggccgtacccggtgtcgcgtgtggaacggccgcgctacagcatacttcgattgacagcggcgcggcaccctctcggtactttcctgatcgcggcacgcgtccatacaaagaaaaacccgcgatgcatgaagccatcgcgggttctcggcatgcggcgcgagcgcgcgcatgaaatctggtgggcccggcggggttcgaacccgcgaccaatcgattatgagtcgactgctctaaccgctgagctacaagccctgaaaagaatcgaagcgtgtcacacgctgccccggcaaagaagccgggccggcattgtaacaacaaaggagacaaacgccaccggcatcacgtggataccggcggcgttcgcaggagagacgctggaaatcagttcccttcgaggaacgacttcagcttgtcggaacggctcgggtgacgcagcttgcgcagcgccttggcctcgatctgacggatccgttcacgcgtgacgtcgaactgcttgccgacttcctcgagcgtgtgatcggtgctcatctcgataccgaagcgcatccgcagcaccttcgcctcgcgcggcgtcagcgaatcgagcacgtccttcacgacgtcgcgcatgctcgcatgcagcgcggcatccgccggcgcgaccgtgttggtgtcctcgatgaagtcgccgagatgggaatcgtcgtcgtcaccgatcggcgtttccatcgagatcggctccttcgcgatcttcatgatcttgcggatcttgtcttccggcatctccatcttctcggcgagcgttgccggatccggctcgagaccggtttcctgcaggatctgccgcgagatgcggttcatcttgttgatcgtctcgatcatgtgaaccggaatacggatcgtgcgcgcctggtccgcgatcgagcgcgtgatggcctggcggatccaccacgtcgcataggtcgagaacttgtagccgcgacggtattcgaacttgtccaccgccttcatcaggccgatgttgccttcctggatcaggtcgaggaactgcaggccgcggttcgtgtacttcttcgcgatcgagatcacgagacgcaggttggcctcggtcatttcgcgcttcgcctggcgcgccttcagttcgccggccgccatctggcggttggtttccttcaggtccttcagcggcagcacgacacgcgcctgcaggtcgagcaggcgctgctgctgttcgcggatcgccggaacgttacgcgacagcaccgcgttgtacgaatggccttcggccatgatcttctcggcccagtcgaggtcggtttcgctgcccgggaagcgcgcgatgaattccgaacgcggcatgccgcacttgtcgacgacgatgtgcaggatctggcgttcgacctgacgcacttcgtccacctgcgcacgcagcgtgtcgcacaggcgttcaacggtacgcgcggtgaagcggatcgtcatcagttcggtctggatcgtttcctgcgccttcaggtaggccttcgacttgtagccttccttttcgaacgcgcggcgcatcttgtcgaaccactcgctgatctgcgagaacttctcgagcgacgcacgcttgagggcttcgagctgggcggcgttggccgatgcctgtgcggcaccgtcatcttcctcctcttcctcttcttcctcttcctcttcggcttcctcgtcctcgttctcgatggcttccgcttccttcgcggagaagccgtcggtatcggcggagtccgaagcattcggatcgagcaagccgtcgacgagctcgtcgacgcggatctcttcgttcgcgacgcgttcggccatcgcgaggatgtcggcgatcgtcgtcgggcacgcggagatggccatcaccatgtggcgcaggccgtcctcgatccgcttcgcgatctcgatttcgccttcacgcgtgagcagctcgaccgtgcccatttcgcgcatgtacatccggaccggatcggtcgtgcggccgaattccgaatcgacggtggacagcgcgacttccgcttcctcttcgacttcatcgtccgacgacgcggcgggcgcgttgtcgttcaggagcagcgtttccgcgtccggcgcctgctcgtagaccgccacgcccatgtcgttgaacgtgccgatgatgccttcgagggcttcggtctcggtgaagttgtccggcaggtggtcgttgatttcggcgtacgtgaggaagccgcgctccttgccgagcttgatcagcgcgcgcagtttcacgcggcgctcttcgagctcctcggccgtacccggcgtgctcgtcgcgaacgcttccttcagcagcgcctttccttggcacgacggtcgcgcaccttggatttgcccggtgcagccgctgctgctgctgcgggctgctcgtcgctctgatttgcgtcgtcttcgacggatacttcgttcagctttttggtcatggagttcgccgtaccggctatatcgactcgcggctgctggacgacagccggttgaaccgtgggtgcatgagtagtacgtactgccgtttcgtccgcagcggcagtcgtgtcccttgcgcttttcgcacttgcccgcttcgccgccggcttggccggcccggagtcggtctggcggcagcccgtgttctggctgccggcgccggcgcagcctgagcagtgccggccgcggtttttcctgctggggctgacgtggctgaagacgttgtcctggtggaagaagcagacttggccgctgtgaccttcttggtcggctccgtcgagcccttgcctgttgctttctttccgcctgtcgtctttgccatcgcgattctcgcctctgcttagaaaacaaaccgctggaaaccttatattatagcacgctggggaaccctctctaagctccccggccgcctacagcccgagccgacgcttcatgtcggttcgctgctggttcaattccgtcaattcggccaattcctcgggtgtgaaggtggattgccgcgccagcctgtcaagccggtcgcagcaagcgtcgtaacgcatcttgagcaccgcggcctgcaactcctccccgcgatccgttcctgctcacgctgccgctcgggcaccgtctcgtcttccggattctgtaacagcaaatcgcggacgttttcatcatagtccagaatttcgcggaagatttcctcgtaagtcgctccattcgaggacgtccgcaggacatcggaaagcagccggaactctgcgccatcgcccagcgcgcgggcatgatcgacgacctccgcgaacagttcgccgatgcgcggcaacgcacgcagggtcgcaagctgttcatcgtcgagctgcgacgcgatgcgcggatgcatcaccagcgtgcgcaacgcacgcttttcgctgtccgtcacgcggcgccgctcgctgcgtgcaggcgcctggcgcggcggtgccgcgatccgcgtatcgacatcggacagccccgcaacctcctcgaacgggatatcgaggcggtcggcgaacatgtgcatgatctgcgcgcgcaacgcgttcgcgggcagcgcctgcaacatcggcttcgcatcgaacagcgccttcgcacggccttccggctgatcgagcgccttgccggcaattgcttcgttcagcagaaattgcgacagcggcatcgcgcgctcaacctgttcggagaacgcatccgcgccgaattcgcgcacgtagctgtccggatcgtgctcggccggcaaaaataggaaccggatcgtacggttgtcgccggcatgcggcaggcatgcctcgagcgcgcgccgggccgcccgccgtcctgccgaatcgccgtcgaaactgaaaatgaccgtatcggtctggcgcagcagcttctgcacgtgaatcggcgtacacgctgtgccgagtgtcgcgaccgcgttcgggaacccgagctgcgcgagcgcgacgacgtccatgtagccttcgacgaccagcacgtacttgcgctcgcgaatcgcgagccgcgcctcgaacaggccgtacagctcgctcccttgttgaacaacggggtttcaggcgagttcaggtactttggctcgccgctgccgagcacgcggccgccgaagccgatcacctgccccttcacattgcggatcgggaacatgatccgctcgcggaaccggtcgtagcggcgcgcgacgccctgcgcatcggtcttctcgctgacgatcacgagccccgattcgacgagcgactcgtcgcgatagtcggggaatgctgcctcgaggttctgccagccgtccggcgcatagccgaggccgaagcgcgcggcgatctcgccggtcaggccccggtttttcaggtactggatcgcgacggtcgcgccgcgcaactgcttgcggtagtagtcgcacgcggcggtcattgcatcggacagcgcggtcgcaaccgatttcgacaccggcgccggatagtcgccgccaccgcctccacccccaccgccgccacgcatcgacggctcgtgcggcacggtcaggccgaccgactgcgcgagctcctgcacggcttccgggaacgtgagccccgcgtgttccatcaggaagccgatcgccgtgccgtgcgcgccgcagccgaagcagtgatagaactgcttggtcggactgaccgtaaatgacgggcttttctcgttatggaacgggcacagccccatgaagttggcgccgcccttcttgagctgcacgtaccggcccaccacgtcgacgatatcgacgcggttcagcaaatcctgcaggaacgaatgcggaatcaccgtgggatcgagcgaaaaagacaatacgacacccggcgcacgcaccgcgtgcgccggggagacaggtgttacttcgaaagcgcggccttgaccagtgcggaaatggccgtcatgtcggcacggccggcgagcttgcccttcaggacacccatcaccttgcccatgtcctgcgggcccgccgcgcccgtctgcgcaaccgcggcctggacttcggcggccacctcggcctccgacaactgctcgggcatgtagccgctcagcacgaccagttccgcctgctccttcgcgacgaggtcgtcacggccggcggcctggaactggctgatcgaatccttgcgctgcttgatcatcttgtcgatcacggccgtgatgcccgcgtcgtcgagggtgatctgatcgtcgacttcgcgctgcttgatcgcggccatcagcaagcgaatcgttgccaggcgctcgctttccttcgcgcgcatcgcggccttcatgtcttcgctgatctgctctttcaaactcatctttcacccgggaaggaaacgtgaatccgacgcccgccatacgggcgtcaacacaaaacccgcttgggactgtgtctcaagcgggttgctcgaatccggcatcggcggctcgcctgatcggtcgcacgatcatgctcgatcatgctcgatcttccgcgatcgcccgatcgcgcggagtcgccggtgcgccgctcagcgaaccgcgcggcgcccaatcgttcagtacagcttcttcggcagcgtctggctgcggatacgcttgtaatgacgcttcaccgctgccgccttcttgcgcttgcgctccgcggtcggcttctcgtaaaactcgcgcgcgcgaagttcggtcaacagcccgttcttctcgatcgtgcgcttgaagcgacgcattgcaacttcgaacggctcgttctctttaacgcgaatgatcgtcatgatccgacacgaataaaggtttgcagggaaagactactgagtatagcagagcgattgcccaaaggcacggggcctggtcccgccaaaacggcgtcggcccggcatgtcaggcgccacgcgaatactccgcggcagcctgcccggctgccgtgccggacgcccacgcccactggaagttgtagccgccgagccagcccgtcacgtccaccgcctcgccgacgaagaacagccccggcacacgcgtgctcatcatcgtcgccgacgacaggtcgcgcgtatcgaccccgcccttcgtcacttcggctttcttgtagccctcggtgccgttcggcgtcagcgtccagccggacagcgcgtcgccgatctggcgcagcgtcttgtcgggcaggtccgcgagccgcgcgtcggctgcaacgcgatgcgtgtcgagccacgcatgcgcgaggcgcgacggcacccagtccgcgagcagcgaaccgatctggcgcttcaacgtgcgcttcgcgtcgagcaggtcggctaccgtatcgcgttgcggcaacaggtcgacgcggatcgggtcgcccggctgccagtaactcgaaatctgcaggatccctggcccggacaggccgcgatgggtcagcaacaggtcctcgacgaattctccgccgcgcttcttgtcgccggtcgatacgcgcacttcgagcgatacaccggacaacgccgcgaacggctcccagtcctgctgcgcgaacgtcagcggcacgagcgcgggccgcgtgtcgatcagcttgtggccgaactgcttggcgagccggtaaccgaagtcggtcgcgccgattttcggaatcgacaggccgccggtcgcgatgatcagtgcacgcgcgccgatcgtccccgcctgctgcgtgtcgagcgcgaagccgtcggccggcgcgtggcgcaccgcgtcgacgacgacgggcctgcgccacgcgatgccgcccgcgtcgcactcgtgcttcagcacgtcgatgatcgcgtcgctgccgtggtcgcaaaagagctggcccttgtgcttttcgtgccaggtcacatgatggcgcttgagcagcccgaggaagtcgcgcggcgtatagcgcgccagcgccgagcgcgcgaaatgcggattcgccgacaaatagttgtcggggcctgcgtaaagattcgtgaagttgcagcggccgccgcccgagatgcggatcttctcggcgagccgcggcgcgtggtcgatcagcacgacgcggcggccgagctgcccggcaaccgcggcgctcatcatcccggcggcgcccgcgccgatcacggcgatgtcataagtttccatggcgcggattgtacccgcccggcctccggcccgggctgcctgcggcggcgacctgcccccgcctgctataatttccggttacgttgaccttcccgcggtgcgctcgatacggcgcgccctgcccgcacccatgctcgttctcggcatcgaaagctcctgtgacgaaaccggcctcgcgctctacgacacgcagcgcggcctgctcgcgcacgcgctccattcgcagatcgcgatgcaccgcgagtacggcggcgtcgtgcccgagctcgcatcacgcgaccacatccgccgtgcgctgccgctactcgaggaagtgatggcgcaaagcggcacgcgccgcgacgacatcgacgcgatcgcgttcacccagggccccggcctcgccggcgcgctgctggtcggcgcgagcatcgcgaatgcgctcgcgcttgcctggaacaagccgaccgtcggcatccatcacctcgaaggccacctgctgtcgccgctgctcgtcgacgagccgccgccgttcccgttcgtcgcactgctggtgtccggcggccacacgcaactgatgcgcgtgaccgacgtcggcgtgtacgagacgctcggcgaaacgctcgacgacgcggccggcgaagcattcgacaagacggccaagctgatcggcctcggctacccgggcggcccggaagtctcgaagctcgccgaaaccggcacgccgggtgcggtcgtgctgccgcgcccgatgctgcattcgggcgatctcgacttcagcttcagcggcctgaagacggccgtgctcacgcagatgaagaaattcgaagcggcgaaactggagggcgaagcactcgaacgcgcgaaggccgacctcgcgcgcggcttcgtcgacgcggccgtcgacgtgctcgtcgcgaagtcgctcgccgcgctgaagaagacgaagctcaagcgcctcgtggtcgcgggcggcgtcggcgcgaaccgccagttgcgcgccgcgctgtcgaccgccgcaaccaagcgcggtttcgacgtgcactaccccgacctcgcgctctgcaccgacaacggcgcaatgatcgcgctcgcgggcgcattgcggctcggccgctggcccgagcaggcgaatgccgactacgcctttacggtgaagccgcgctgggatctcgcgtcgctcgcacgctgagcgacgccccgcgacacaacgccacaccgacaaacgaaaaggccgctcatacgagcggcctttttcatcggcgcggcaaaacgacgcagcgttatgcagcctgccgcttgtcgcgttcgatcaatgcatacgcgctgtgattgtggatcgactcgaagttctcggcttcgagcacatacgcgaccacgcgctcgtccgcgtcgagacgctgcgcgacgtcgcgcacgagatcctcgacgaacttcgggttctcgtatgcgcgctcggtgacgaacttctcgtccggacgcttcaacaggccccacagctcgcacgacgcctcttcctccgcgatgcggatcagcgcctcgaccggcaggtcggccgcgagctccgcgtcgatcgtcacgtgcgagcgctggttgtgcgcgccgtattgcgagatcttcttcgagcacgggcacaggctcgtcaccggcacgagcaccttgaggaacaggcgcgtgtcgccgttgcggctttcgcccgcgagcgtcacttcatagtcgagcaggctctgcacacccgacaccggcgccgtcttgttcacgaagtacgggaacgtgacctcgatgcggcccgcctcggcttccagcttctcgagcatcgacgcaagcatcgcgcgaaaacgctcgaccgtcagcggcgcacggttctcttcgagcagcgcgacgaagcgcgacatgtgcgtacccttctggtcggccggcaggcggacgtcgagattccagacgccgacggtcggctgcacgtcaccgccttcggtacacaccgtcaacggatgccggaccgccttcacgcccacgcgctgaatcggaatctggcgggtatccaccgtgctctgcacgtcgggcatcacgaaggcgggattcatctggttcatcttgttcaatccttgtaagccgcgcgttcgatgacgcgcacgccgcgtcatgcggcagccggaaagcaacatgggcccgcaggcccatgttttccgcatcaatgaagaccggtcgcgccagtcgcaccggcaccgcccgcgggcggcgccggcttatgcgacgcgcttcgcctgaccggcgacatcggccgccggattcagaaagcgttcgcgaatcgatttcgcgatacccgcgccgtcgaggccgcattgcgacagcagcttcgcggggtcgccgtgatcgatgaacaggtcaggaggcccaattgtagtacgggtcggataaccccactctccatcagggcttccacgcaggccgagcccgcgccgcccatcacgcaaccttcctcgaccgtgacgaggtagtcgtgcgtctcggcaagttcacgcacgagcgccgcgtcgaccggcttcacgaaacgcatgttcgcgacggttgcatcgagttcctcggcggcggcaagcgacggtgcgaccatcgtgccgaacgcgaggatcgcgacgcgcttgccttccggctgcgacgtgtggcgacgcacttcacccttgccgagcgggatctcggtgaactccttcaccgtcgccacgcccgtacccgcgccacgcggataacgcaccgcggtcgggttcggctgttgcagcgccgtgtgcagcatctggcggcattcgttctcgtcggatgcggccatgatcgtcatgttcggaatgcagcgcatgaacgcgagatcgtacgcgcccgcatgcgtcgcgccgtccgcgccgacgaggcccgcgcggtcgatcgcgaacacgaccggcaggttctgcagcgcgacgtcgtggatcagctgatcgtacgcacgttgcaggaacgtcgagtagatcgcgacgaccggcttgagcccttcggtcgcgaggccgcccgcgaacgtcaccgcgtgctgctcggcgatgccgacgtcgtagtagcgatccttgaagcgcttctcgaattcgaccatgcccgagccttcccgcatcgccggcgtgatgccgacgacgcgcgtgtcgcgctcggcttcatcgcacagccactcgccgaacacctgcgtgtacgtcttcttcgcgggcgtggcggacggcttgatgccttcggccggattgaacttgcccgggccgtggtagagcacgggatcggcttcggcgagcttgtagccctggcctttcttcgtcaccacgtggaggaactgcgggccgcgcagttcgcggatgttctgcagcgtcgggatcagcgaatcgagatcgtgaccgtcgatcgggccgatgtagttgaagccgaactcttcgaacagcgtggccggcacgaccatgcccttcgcgtgctcttcgagcttgcgtgcgagttcgagcaccggcggtgcaacgctcagcacgcgctcgacgcccgcgcgcgcagccgcatagaaacggcccgacatcaggcgtgcgagatggcgattcagcgcaccgaccggcggcgagatcgacatgtcgttgtcgttgaggatcacgagcactttcgcgtcttccgacacgcccgcgttgttcatcgcctcgaacgccatgccggccgtcatcgcgccgtcgccgatcacggcgatcgagaagcggtcgtcgccgttcagctggctgccgatcgccatgccgagcgcggccgagatcgacgtgctcgagtgcgcggtgccgaacgtgtcgtattccgactccgaacggcgcgggaaccccgagatgccgtcctgctgacgcagcgaatgcatctggtcgcgacgccccgtcaggatcttgtgcgggtaggtctggtgccccacgtcccagacgatgcgatcgttcggcgtgttgaacacgtagtgcaacgcgatcgtcagctcgaccgtcccgagattggacgacaaatggccgcccgtcttcgacacactgtcgagcacgaacgcgcgcagttcatccgcgagcggttgaagttggcgacgatcgaggcggcgcaagtccgccgggtcgtcgatggttttcagcaagtcgtacatcgtcgttccattgtaggaaatcaaacgcgcccgcattctgttgcacgcaccgtagcatgtgcgcggcggcgggctttcgcgtcagctgacccggttcactaccaggtcggcaagttcggcgagacgctgagcgcgtgcgccgaacggtttcagcgcgtcgtgcgcttcggcgcgcagttgtgctgcgagctcgcgcgacgcctcgaggccgaggatcgatacataggtcggcttgtcgttcgctgcatccttgccggccgtcttgccgagcgtcgccgaatcggtcgtgacgtcgagaatgtcgtcgacgacctggaaggccagacccacggcccctgcgtacacatcgagcgccgccatcgtttccgccgacggcgtctcgccggccagcgcgcccatccgcacggccgcgcgcaacagtgcgccagtcttcatccggtgcatcgtctcgagctgctcgcgcgtcagcttgaggccgacgctcgccaggtcgatcgcctgcccgccggccatgccgatcgagccgctcgccagcgccagctcgcgcacgagcgcggcctgctgcaccggcgacagcgcagcggcgtcggtcagcgcaacgaatgcctgcgactgcagcgcgtcgccgaccagcagtgccgtcggctcgtcgtactgcacgtgcacggtcggcttgccgcgacgcagtgcgtcgtcgtccatgcacggcatgtcatcgtgcacgagcgagtagacatggatcatctccagtgccgccgccgccgcattgcgcgccgcttccgtcgcgccggtcagttcgcctgctgcatggcacagcagcgggcgaacgcgtttgccgccgccgaggaccgcgtagcgcatcgcctcgtggagtttcgccggcaccgcggtttcagcgggcaaatagtggccgagtgcgtcctcgacacggtcaagcacggaccgcatccattgttcgaatgtcatagatcgtcgtcttcgccgtccgtggcggccgttccggacgaaagcggcttcagcgtcgcgccgtcgagcacgcgaacctgctgttccactttctcaagctgctgttggcaaaacgcaacgagggtcgcaccgcggcgatacgccgtcagcgaatcctcgaggctcaacgcgccgccttccatccgggcaaccagcgtctcgagctccgcgagcgccgtctcgtaattgtccggcaacggttcggtgccattgccgggcggcgtggcgcctggggatgcggttttcgccatggacgagggtgtcaaatttcaaaacaagtcggacattctacggcaaagagaattttccgacctgccgtcttgggcacccggctacatattccggccccaccttcgacgcacattgtgcgccttccgattcccgcccgacaaaaattgacacaaatcaggcacttaatcctggccttgcgaggcgaaccgggtataattccgcgtttccctaaatcgatttttcgatggttgggttgttcactgctttcacgctaacaccgggagtgggaatgtccaatctgagcgatgcgcttcagttgaagtcggcccacagccagcttccagtcactgcatacttcgatgaggcgctactcgagcgcgagatcgaaaccctcttcaagaaaggacctcgttacgtcgggcacgagttgatggtgcccgaggcggggattattttgcgctgccgtccgagaaggaaggtcgcgtgctggttcgcaaccccgcgaaccagatcgaactgctgtcgaacgtctgccgtcaccggcaggcgatcatgctcaacgggcgcggccacacgcagaacatcgtgtgcccgctgcaccgctggacgtacgacctggacggccagttgctcggcgcgccgcacttccccgacaagccgtgcctgaacctcggcaagagcccgctgcagaactggcaggggctgctgttcgaagccgaaggccggaacgtcgcgcgcgatctcgcccatctcggcacgaagcatcacttcgacttctccgagtaccacttcgatcacgtcgaagtgcacgagtgcgattacaactggaagacgttcatcgaggtctacctcgaggattaccatgtcgtcccgttccatccgggcctcggcagcttcgtgtcgtgcgacgacctcaagtgggagttcggcgactggtacagcgtgcagacggtcggcgtgcacaacgccctcgcgaaaccgggcagcgcgacttaccagaaatggcacgagcaggtgctcaagttccgcaacggcgtgccgccggagttcggcgcgatctggatggtctactacccgggcctgatgatcgagtggtatccgcacgtgctcgtcgtgtcgtggctgatcccgcgcggtccgcaaagacgaccaacatcgtcgagttctattaccccgaggaaatcgcgctgttcgaacgcgaattcgtcgaggcggaacgcgccgcctatatggaaacggccgtcgaggacgacgaaatcgcgatgcggatggacgcaggtcgccgtgcgctgatggcacgcggcgagtcgcaggtcggcccgtaccagagcccgatggaagacggcatgcagcacttccacgagttcctgcgccgccacctcggcgacatctgaaagccggtgcggcgctttgacgccgcacggcatccggcagacgaaaagacgggcttcggcccgtctttttgtttagacttggaatgtcaggccattcgcactccaggagccgtcatgccacacacccactacaccacactcatttccgccgccaatctcgccgagcgcctggcggcggcgcccggcagcgtcgcactgttcgattgtcgcttcgatctcgtcgatcccgccgccggcgaagccgcgtatgcggccggtcatatccccggcgcacagtatcttcatctcgaccgcgacctgtccggccgcaagacgggcaccaacggccgccatccgctgccgacccgcgacgcactcgccacgctgctcgcgagccgaggcctcaagcagggccagcaagtcgtcgcgtacgacgcacagggcggcgcctatgcggcgcgcctgtggtggctgctgcgctggctcggccacgattcggtcgccgtgctcgacggcggcctgcaggcctgggaagcagccggccagcctctcgcgaccgacgtgccgcacccggccgccggcgatttccgcgcggctgcgccgctcgaatcgacggtcgacgcggcagccgtgctcgccaacgtgagcacacccacgcgcgtcgtgatcgatgcacgcgcacccgaccgctaccgcggcgaaaacgaaacgatcgatcgtgtgggcggccacatccccggtgcgcgcaaccgcttcttcaaggacaacctcgccgcggacggccgcttcaagaccggccatgagctgcgcgaagcgttttctgcggtgctggctggcaccgaaccgaaccgcgtgatcctgcaatgcggctccggcgtcaccgcctgccacaatgcgcttgcactggaggtagcgggcctgcacggcgcgtcgctgtatccaggctcgtggagcgaatggagcgccgatccgtcgcgaccgatcgcaaccggcccgacaccgtaagcgcggtcgcaacgcagcggcggcatgtgccgccgcttgccggttacatcacgccgtacttgtggaaccacgcgatcgcgcgcttccagctctcctccgcatcggccttcacatagctcggccggtaatcggcaaagaacgcgtggccggcatccggatacacgacgatctccgattcgcgcgcgagcttcgaatcgctcgcctggatcgccttgcgcatgtcggcgagcgatgcctgcgtgatgttcgcgtccttctcgccgtagagcccgagcacgggcaccttcagcaacgatgcatgatcgaccgggttgaacggcgtcatctcgtcggtcttgccttcgacgaacccgtaccatgcaatggccgcacgcacgtgcgggttgtgctcggcatacagccagctctgacggccgccccagcagaaccccaccacgccgagacgcgacaggtcgccgccgttcttgccggcccacgtgacggtcgcatcgagatcctcggtcacctgccggtcaggcaccttgctgatgatgtgctcggacagatccttgatcgtcggatacttcgccgcattgccctgccgtacgaacaggtcgggcgcgatggcgagataaccgagcttcgcgaagcggcggcagacgtcggcgatgtgcgcgtgcacgccgaagatctcgtgaatcacgatgacgaccggcaggttcgtcttgtccttcggctgcgcgcgatacgcgggcacgctcgcgtctcccgagcggatctcgacggtgtcgacgtccagcccttcgctgtcggtcgtgaccgtctgcgccgacacgggcagcaccgccgctgcgaaggccccgcccagcgcggcctgcatgaacttgcggcgcgagaacggaacgtggggaaccaggctgtcgacttcgggtttcaacatgaatgcactcctcgattgggcgccgccgtcacgatcgcgaatacggtatgacgtggcatcgcgccggcatgcggcgcggatgtcgcggcggttggcaccccgccgcaaacggaaacccggacaagatgcccaataatccgttgtcacgtcaactgtcggatatgtaagactcgattacggcgcgttgcttcgacacgccgatcgccgcgcaaaaaccgcaggcgacccatcgaatcgcgatgcaacaagccgcatgtcgatcgccgtcgagcgatcggatgctggcgaattgaaacgaaaaacacgcggtcgatgttgcccgtcacacgccggcacggcagcccgcaaagaacgacgggcagggactacgcacgacgtgcgctcccgcccgcttcccgcgcgaacgcgcgctcagtgcaacttgacgcgcggcagcgtcgtgcgccgcagccagtgcgcaaccgtgtcgagcatcatgcgcggatagccgtgcagcgcggcgatgtgcatccggtacagcgacatgtacatgaagcgcgcgaacagcccttcgatcagcatgttgccgccgatcagcccgcccatcaggttgccgaccgcgctgaaatggccgagcgacacgagcgagcccaggtcgcgataggtgaattcgggcagcgggcgcccgtcgagccgacagccgattgccttcagcaggaagctcgcctgctggtgcgcagcctgcgcgcgcggcggcacgttgcgctcgttgccgggccatgcgcatgccgcacaatcgcctagcgcgaacacgttgtcgtcggtaaaggtctgcagcgtgcggcgcacgtcaagctggccgagcttgttgacctgaaggccatcgagattggcgagcactgacggcgccttgatgcctgcggcccagaccgtcaggtcggcacgcaccgtcttgccgctcgccgtatgaacggccccgggcgccacctcggtcacgcgctcggcaagcatcagccgcacgccgatcttttcgagcagttcggccgtcgccgacgacacgcgctccggcaacgccgggagaattcgcggccccgattcgatcagcacgatgccgacgtcgtgccgcgggtcgagcttgtgcagcccgtaggccgacaacacctgcgcggtgttgcgcaactcggcggacaactcgacgcccgtcgcgccgccaccgacgatcacgacctggatgcgcggctcggccgcctcgcccggcgcggtcggcgccggcgcctgatgttccgcacgcatgcacgcggcgatcagccgcttgcggaaacgctcggcctcgccgaccgtatcgagcgcgatcgcgttttccgatgcgccctgcacgccgaagaagtgggtcgtgctgccgatcgcgatcacgagcgtgtcgtattccagctcgcgcgccggcagcagttcctcgccgtcgctgtcgttgatgggtgacagcgtcaagcgtttcgccgcgcggtcgagtccggtcagctcgccctgctggaattcgaagccatgccagcgcgcctgcgccgcatattcgagctcctgcgtgaacggatccatgctgccggccgcgacctcatgcagcagcggtttccagatgtgggtcggattgcggtcgacgagcgtgacaagcgcacgcgcgggacgattgccgcgcgcgccgtaacggtcgccgagccgcgtcgccagttccaggccgcccgcgcctccgcctacgatgatgatccgatgcatctgttcccctttgcgattcgaaactgctgccgcctgacagtgcgaacgcgatgcattcgcgccacccgttggattaaccggttcggacatcatcgatgtgcagttcgaagcacttcgatgcgaccgctccgggaacgcgggcgcgcaagccccgtgtccatgacatgcattgtccgggagcttgcgcgttgaccacaagcaaaccatctcgatattcagcatccctgcaacaatatgccgcaggaatcgggaaccgcgtggcggtgcgtcagtgtgcctcttcccagttcgcgccggcacccacttcggcgacgagcggcaccttgagcttcgccacgccgcacatcatttccggcagtttctcgcgcaccagcgacaactcgccgtcgggtacctcgagcaccagttcatcgtgcacctgcatgatcatccgcgacgcaagcttgtcgcgcgtgagccagtcgtccaccgcgatcatcgacagcttgatcaggtcggccgccgtgccctgcatcggcgcattgatcgccgcgcgctcggctgcctggcggcgcggcccgttgccgccgttgatctcgggcagccacaggcggcgaccgaaaacggtttcgacgtagcccttctctttcgccaccgagcgcgtgtcttccatgtactgcgcgacgcccggataacgggcgaaataccggtcgatatagagcttcgccgcatcacgcgtaatgccgaggttcgacgcgagcccgaacgcgctcatcccgtagatgagcccgaagttgatcaccttcgcgatccggcgctggtcggaattgacctccagcggcgtcacgccgaacacctcggcggccgttgcacggtgaatgtcctcgccctgcgagaacgcgcgcagcagcgacgcatcgcccgaaatatgcgccatgatccgcagttcgatctgcgaataatcggccgacacgatccggtggcccggcgaggcgatgaacgcctcgcggatccgccggccctcggccgtgcgcaccggaatgttctgaagattggggtcgttcgacgcaagacggcccgtgaccgcgacggcctgcgcgtagttcgtgtgcacgcggcccgtggacgggttcaccatgcgcggcagcttgtcggtataggtcgacttcagcttcgacagcccgcgatgctcgagcagcagcttcggcagcgggtagtcctcggccagtttctgcagcacttcctcgtcggtcgacggcgcgccgctcggcgtctttttcacgaccggcagttgcagcttctcgaagaagatctgcccgatctgtttcggcgagccgagattgaattcgccgccggccagttcgtacgcctgcccttcgagttcgatcaggcgcgtcgcgatttcggtgctctgcgcctgcaagcgcgcatcgtcgatcaggacgcccgtgcgttccatcttgcgcagcacgagcgacacgggcatttcgatctcgcgatacacgcgctcgaggcccggttcgcgtgcgacctgcggatacagcacgtgatgcagctgcagcgtgatgtccgcatcttcggccgcgtatgcggcggcctccgcaagcgccacttcgtcgaaaccgatctgcttcgcgcccttgccggccacgtcttcgtacttgatcgtcttgacgcccagatgacgcagcgcgaggctgtccatgtcgtgcgtgcggtgcgattcgacgacgtacgattcgagcagcgtgtcgtgctcgatgccgctcagttcgatgtcgtagttcgcgagtacctgcgcgtcgtatttcaggtgctggccgaccttcttgcgatcggccgattcgagccacggcttcaggcgcgcgagcacttcgtcgagcggaagctgttcgggcatgtcggggccgcggtgcgcaaccggcaggtatgccgccttgcccggctcgatcgagaacgacaggccgacgagccgtgcgagcatcgggtcgagcgaagtcgtctcggtgtcgaacgcggtcagcgcggccgtgtcgatcttggcgaaccacgcgtcgaactgctcccaggtctggatcgtgtcgtattcgcggacgatgtcggctgccaccaccggcgccggctcgccttccggcgcatcggcgccgccgccttcggccggcgcgctgtcgacttcgcgcagccaggtcttgaagccgtaacgcgcgaagatgtcgcgcatcatgtcgcgggcttcgccgtccgtcttcaacgacgcctcgatcgattcgaggtgcggcgcgagatcgcaagccgtctcgacggtcacgagcttgcggccgagcggcaggaagtcgagcgcgcggcgcaggttgtcgccgaccacgcccttgatgtcgcccgcatgctcgatcacgccgtcgaggctgtcgtattgggccagccatttcacggccgtcttcggcccgcacttctcgacgcccggcacgttgtcgacggtgtcgccgatcagcgcgaggtaatcgatgatgcgctcgggcggcacgccgaacttcgcgatcacgccgtcgcgatcgagcgtctcgttggtcatcgtgttgacgagcgtgacgcggtcggtcacgagctgtgcgagatccttgtcgcccgtcgacacgatcacgttcatcccgtgccgctcggcttcgcgcgcgagcgtgccgatcacgtcgtcggcctcgacgccttcgaccatcagcagcggccagccgagcgcacgcacggcgccgtggatcggctcgacctgcaacgcaagatcgggcggcatcgacggacggtttgccttatagtcggcataaaggtcgtcacggaacgtcttgccctttgcatcgaacacgcaagcgctatactctgcactgacttccttgcgcatacggcgcagcatgttgatgattccgtagagcgctccggtcggctccccgccagggccacgcaaatcaggcatcgcatggtaagcccgatacagatagctcgaaccgtcaaccaatagcagggtcttaccttccagatttcgttcttcaggcattatgaacaagagaaaagtgattccgagtctgcgttcgctcgcagatcaagaacgcgcgacggccaagaaggcgcgcgcatcgtggcagatgttcacgattatggcagagtttatcgaggcgaccgagtacctgtcggagatccgcccggccgtcagcatctacggttctgcccgcctcaagcccgacacgccgcactacaagctcgccgtgcagatcgcacgcaagctgtccgacgccggcttcgccgtgatctccggcggcggccccggcatcatggaagccgcgaacaagggcgcgcacgccggcaaggcgccgtcggtcggcctgaacatcgagctgccgcacgaacaggccggcaaccactaccaggacatctcgctgcgcttccgccacttcttcacgcgcaaggtcacgttcgtgaagaattcggatgcggtgatcgtgatgccgggcggcttcggcacgctcgacgagctgtcggaagtgctcacgctgatccagacgaagaagtcgcgcctcgtgccgatcatcctcgtcggcagcgagttctggaaggggctgctgcaatggttccgcgaccagttgatcccgatgggcctcatcaatccggaagacatgaacctgatgcaggtgatcgacgatcccgaccaggtgctcgacgccgtgctcgcgttctacgaggacagcggcgaggaagaaggttcggacgacgatggccatccgccgcgccccgaagaagaccggatgttctacctgtaaccggtcgatgaagaccgccggcccgagggccggcttccctttccgcgcggcaggcgtggcgatcccgccacctgccgtgtgtcagtttgtaacgcgccattaatcgcgcttggcgtgccatacgccgtcgaatgtcaaattcgcaaggccggtgccgtgcgacgcgcgcaatcatccgcaaacgcgggccgccattgtcaaatgacgcgacccggcgcccgtaccctgcgcctgccggccgccaatccgccgtaacaaacccgcctcgcgttttccgtcgcgcaccagcacactgcatgtgtcggtgcggcgtttccggtggaacgatccccctcgcttccatcgcgtcgcgccggcctttacaacgacatcacggaaaagaacatgcaacgctcgctgatcgcccttgccttcgccggccttggcctttcgctgtccggcctcgcccacgccgtcaacgtcgacgtcaacatcggcacgcccgcaccggtcgtcgtcgcgcccgcgcccgtcgtggtcgccccggcgcccgcggtcatcgtcggctggcacggcgaccgctactgggacggccaccgctactgggaacgccgcgaatgggaagatcaccagcgttatcgcggccgcgaacatggcccggatcgccgcggctatcactgcccgccggggcacgcgaagaagggcgagtgctgagcaacagcgcaatcgcctgaccggcaaggccgcccgtgcgcttcagcgccgggcggccttgtcgctttcagcggcgcgctccgcgccatccctgcccccaccggcgatgcgagcggcaagcccgactgccgcgcacgccgcgggccggtgcagcgcgtgcctgcaaccgcccgcacgaccgtgggaaccaatggtaggatcggccctgtccatggccattcccgccacccatgccactcatccggatctgggctgtcgaccatgcccttgcgtctggcatcgccgcgccgaccgacatcttcacggcagccaatcatctcgccccgtcattgcgtatcggccggccgcaagccccgtttcgctggcgcatcgaatcgatcgacggcaagccggtacgcacggcttccggccaggccgccgcggtcgacggcacgatcgacggtcacgggaccgccgatgcgatctggctcaccgctccgttcgtcgccgatctcgagcggctgctcgcccggccggcgtcactcgcgccgctgttcgacgcgctgcgccggcaacatgcgcgcggcacactgatcgcgacgtactgcacgggcgcgttcctgctcgcggaagccgggctgctcgacggccgcgtcgccacgacgcactggtcgaaagcatcgagcttccgcgtacgctatccggacgtggcattgcgcgcgtcggacgtcctgaccgaacaggacggcatattgtgcggcggcgccgtcacgtcgtatcagaatctcgcgttgcgggtcgtcgacaaactggcgaacgcgcgccttgccgcggccgtcgccaaggtcatgctgatcgacgtgaaccgcgtgtcgcaagattcattcatcgatctcggccggatggggcatgacgggcacgacgatgcggccatcgcacgcgcccaacgctggatggaaaagcacctgcgcgagccgttcagcctcgcccggctgagcgatcacgtcgcgatgagcgaacgcacgctccatcgccgcttcagggacgccgtgggcgcgccgccgctcaggtatctgcagacgctccggatcgaagtcgcgaagcggctgctcgcggaaacgacgctcgcgatcgacaccgtctgcgagcgcgtcggctatgcggacatcagcggcttccggcaactgttcaagcgcgagaccggcatttccccggcgagtatcgccgtcgcttcacgcgataaacgcgcgcaaccgtcgtcgggtgcagtgtcggaaatggcatcgtcgaatggcagtttcgccactccgcgtggcggcatgcggttcgtacactggattcacgtcgcccagcatcggagcgacgccatcctcaccgaaccaggacaccatcatgccgatgatcgacgtctacattcccgaaggtgcgctcgcaccgcaggccgaagcccaactgatggaagaactgaccggaacgctgatccgtcacgagggactcgatcccgacgatccgcgcacgcgggacgtgacctggatcttcgtccatcggccggcagccgtgtatcgcgcaggggctgtcgcgcctgcgccgatctaccggatcgtgccgaccgtgccggaaggtcagtacacggatgccgcgcgtgccgggctgatcgcggacgtgaccgctgccgtcgcgtgcgcggagggcctgccggtcgatgccgtcgcgacgcgcgtgtgggtctttccaacggaaatcgacgacggctgctggggcagccgcggcgtcgtgcgccgcctgccggacatcatggaatatttcggtggcgccgaactgcgggcgctcggggaatggcggctggcgatcaagcgacaggcggatgcgggtcgggtcgtcgatgcggtgcgagattcgatgttggaaacggctcggagtggatcgcatgaaccggccgccaaagccgcgcgctgaccccggcgcgcagctgcttgtccgacacgcacagcagcgtgccggacggcacgaaaaagcaatacgcggacgagatgcgcccaagggcgagcgcacctgttcaatcacttattcggtcaatagcacggacactttttgacagggccgggaccaatcaccgcgacgggtttgcaggggttggacggaccgattactgcgacgggtgcacaaggattggacgggccgatcaccgcggttgcggccattgccgacagagatgtggtgaacatcagggaagccagcaagagattgattttcatcaggtatgccctctttcattttgataggaatcgatcggatcgactgttcgccgttccttcgtacgggcgtcgaataacgccgcgcaggagagcatattctcgatgacagaggcaaccaataggacaacttccaaattgcagaaaatgatcgagttccagtactaaggccgcgacgcggccaccgcgagtgactacgcacggccagacggagcggtacaagtgcacgcctgccgccttgaagcccgtcatgccccgggtcgcgattgcgcctgacatcgcgacgcacaccgctcccggggccgccgttcacatcactggaacgccacttccgcaaagctccgcagcttccggctatgcagcttgtcgagcccgttcgtgcgcaggatctccatcgccttcacgccgatctgcagatgctggtcgacctgcccgcgatagaacgtatcggccatgcccggcaacttgagctcgccgtgcagcggcttgtccgacacgcagagcagcgtgccgtacggcacgcggaagcggaagccgttcgcggcgatcgtcgcgctttccatgtcgagcgcgatcgcgcggctctgcgacaggcgctgcacgggttcgcgatgatcgcgcagctcccagttgcggttgtcgacgctcgcgacggtgcccgtgcgcatcacgcgcttcagttcgacgccatcgagccgcgtgacgtcggccaccccgcgctcgagcgcgagctgcacttcggcgagcgccggaatcggcacccacagcggcaggtcggcatccagcacgtgatcctcgcgcacgtagccgtgtgcgagcacgtagtcgccgagacgctgcgtattgcgcagccccgcgcagtgaccgagcatcacccatgcgtgcggacgcagcaccgcgatgtgatcggtgatcgtcttcgcgttcgacggaccgacgccgatgttgaccatcgtgatcccgctgccgtccgcgcgcttcaggtgatacgcgggcatctgcggcaggcgcggcggcgcggcgccctcggccggctcgctgccgaggttcgcgttgtaggtcacgacatcgcccggctcgacgaacgagctgtactggctgcgatacgcgcgcacctcgggatcgtcgctctccgtcatcaccgtgcggcccagcttcacgaactcgtcgatgtagaactggtagttcgtgtagagcacgtagttctggaaatgcgtcggcgacgtcgccgtgtagtggcgcaaccggtgcagcgagaagtcgacgcgcgcggccgtgaacagcgcgagcggatgcggctcgcccggcgccggctcgaacgtgccgttgacgatgcgatcgtcgagatacgacaggtcgggcgtatcgaagatgtcgcgcatcgcgagcaggcggtcgcggtcgagctcgccctcgagatggatgccttcgggaaacgcgaaatggatcggaatcggctgcgacgacacgccgatctcgatcttcacatggtggttcttcgccagcaggcgcagttgctcgcgatagtagttcgcgaagaggtcggggcgcgtgaccgtcgtctcgaacacgccggggcccgcgacgaaaccgtacgagcggcgcgaatcgacgtgcgtgttgacatcggtgcggatccgcacgaacgggtagcacgctcgcacgtgctcggtgatcggttcgtggcggcgatagcgcgcgaatgcgtcacgcaggaaacccgtgttcgtgtcgtaaatggcggacagccgcgcgacggcggcgaccggatcgtcgaaagcctcgaccgacgggctctcgggcgtcagcacacggtgccggcggctcaaatcgttcttcattttcatcacctcgtctgatccgacgacattaccacggaacccggtcgcccttgtggctgcccccacgcacgcgagggccggatggtgcgcagtatttgctaaaatcggtgggttcactggagactcatcatgaagccgctcattctcgtcgtcgctgccgccgcgtttgccgccgccagcgccgcttacgccgccggcggcacgcctgacgccgacgcgcaggcacgggccgaggccaacgaggccgccggcctgcccgatctccgcaagatcaaccggccgggcgccgaagtcacgtcgaaagtcgacttcgccgacatccgccgcacgccgagcttccacgaaagagcaagaacggcaccgaagtcaccgagtaccgcgatcgcggcaagccggtcgagatcgacgtgaagtcgaacttcggcacgcgctaccagatgagctcgacgcccgacacgtcgccgaagccgcacgacgcgggcatcccgatcacgcgcctgccgtcgctgaacctgcgctactgattccgtggcgcgccgcaccgaacgccgcgcgccgcttcccttcacctgctgtcgcgacgcacgccgcccgcgtgccgcaccctgacctgacgcatcccgcatggccgttttcacagctgtttccgactccgatctcgcgcaatggatgcgccactacgaactgggcgacgtgcttgcgttccgcggcattccgtccggtatcgaaaacagcaatttcttcctgacgacgacgcgcggcgaatacgtcctcacgatcttcgaaaacctgacggcgcagcaactgccgttctacctcgacctgatgcgccatctggccggccacggcgtaccggtgccggatccgatcccgcgtgacgacggcgcgttgttcggcgagctgcacggcaagccggccgcgatcgtcacgaagctcgacggctccgccgaactcgcgccggggtcgaacactgtatcgaggtcgggcagatgctcgcgcgcatgcacctcgccggccgcgactatccgcgcaaccagccgaacctgcgcagcctgccgtggtggcaggagaacgtgccggcgatctcgccgttcatcaccgacgcgcagcgcgcgttgctggaaagcgaactcgcgcatcaggccagcttcttcgcgtcggacgattacgcggcgctgccagccggaccgtgccattgcgacctgttccgcgacaacgtgctgttcgcgcacgcggcgcccggcaccggccatgacgtgcggctcggcggcttcttcgacttctatttcgcgggctgcgacaagtggctgttcgacgtcgcggtcacggtcaacgactggtgcgtcgacctcgcgaccggcgtgctcgacgtcgcgcgcgccgatgcgctgctgcgcgcgtaccagaccgtgcggccgttcacggccgaggagcgccgccactggagcgacatgctgcgcgcgggtgcgtaccgcttctgggtatcgcgcctgtacgacttctacctgccgcgtgcggccgagatgctcaagccgcacgaccccggccatttcgaacgcatcctgcgcgagcgtatcgcgcatacgcccgcgcttcccgagatccaaaccgcatgcaactgatcgaagtgcccgcgaaaacgggctatgtctggttccgccaaggcatctggctgttccgccggaacccgctcgcgttcatcacgctgttcttcacgtacctgctggcgatcacgctggtgtcgcaggtgcccgtgatcggctccgcgctgccgctggtgttcattcccggcatcgcggtcggcttcatggccgcatgccgcgacacggtggccgggaagcccgtgatgccgacgatcctcatcgacggcttccgctcgtacggcaccgtcgcgacccagcggctgctcgtgctcggcgtgatctacgtcgcgtcgatggtgctcgtgttcgctgcctcgtcgttcgtggacggcggcgcgctgttccacgtgatgatgggcgcggccgacgaagcgagcgcgacgccggaaacgctcgccgcgcaaggcacgttcggcgcgctgatgttcgcgacactgctctacctgccggtcgcgatgctgttctggttcgcgccggtgctggtcgcgtggcatgacgtgccgcccgccaaggcgctgttcttcagcgtcgtcagctgctggcgcaatcgcggcgcgttcgtcgtgtacggcgcgctgtggttcggcgtcgcgctcggcacgtcgctcgccctgtcgctgctgctgcaggcgctcggcgccggcgcctatgcgctgacgatcatgatgccggtgacgatcgtcatcgtcacgatgctgtactgctcgttctacgcgacctatcgcggctgcttcggcatccaggagccgggcgcgacgaccaccacgtccggtcgctgaaatctccccggccggcgcgtgtcgccggcccgccgcgctcgcgccgggttgccgcccggcgcctcctccgttcccccctccgtcggccaccgccccgcgccggccgcccctgttcatcccgatcttttgcgcgcaaaatgatttgcgtacaaattgttcgcgcgttcgacgcgccgcccgaatgatggaccgcccgcccccgctgccccagacgctcgacgagcaactctgcttcgccctctactcgacttcgcacgcgatgacgaaggcgtacaagccgctgctcgacaagctgtcgctgacctatccccaatatctcgcgatgctcgtgctgtgggagcgcgacgacatcgccgtgaaggacatcgccgcgcggctagacctcgacccggccacggtcacgccactgctgaagcggctggaggcgctcggttacgtcgagcgcgtgcgcagcgcagccgatgaacgcgtcgtgaacgtgcgcgtgacacaggaaggccgtgcactgaaggagcgcgcgcgctcggtccccgccgatctgttctgcgcgatgcagcagtccccgagttcctggtcaggctgcgcgccgatctccaccagttgcgcgacgcgctgtcggccgccaacgaacgctgacgggaaagcatcgacgaaccggcccggcactgccgggccttttcttcaaactttcatttgcacactaatcatttgtgttctatattttcttcgtggccggcgacaccccgttcgaccgggccgcttttcctcccttttcccgacaggagctgcacgatgaacattctgtacaagaccagtgccacgagcacgggcggccgcgacggccgcgcggtatccgctgacaacaagctggaagtgaagctggccgcgccgcgcgaactcggcggcacgggcgcggaaggcacgaatccggagcagctgtttgccgcaggttactcggcctgtttcctgagcgcgatgaaattcgtcgccggccaggacaagaaggcgctgccggcggacacgcaggtcacggcggaagtgggcatcgggccgaacgacgcaggcggcttcgagctcgacatcgagctgcgcgtgtcgctaccggggctcgacaaggccgacgcgcaagcgctggtcgaaaaggcgcaccacgtgtgcccgtattcgaacgcgacgcgcaacaacgtaccggtgcgcctgacggtcatctgacgcaacgcgacgccacgcatgcaaagggcgcgtgcggcatgtagccgcacgcgcccttttctgctgcgtgactcgccggaatggcggaccggccggcccgccctgcgctgcttagcgcgcgccgaacgaatacgggcggttcatcgccgattcgcgatcgatcttgcgcatgcggaattcgagatcgtagatatcggtggcttcggacaggtacgcctcggcgcgctctttacgggccgtttcagcgttcttggtcagcatcaggaagaggtggctcagcaggtacatggtcgatctcgcaatccaagggttctttgactagggttttcccggattataggaaaaccctagtccttggccagcgtcgatcagacgatgcgtcgttcggtcgccacagtgcgccgctgtgcctcgaaaaaggcccagatcatcgcgctcgcatcagggccgaccgccgcatgaaacggcacggcttcatcgccgccggcccacgcatgatcgagccctttcacatgacagagccgcacgacaggctcgccgtcgcggcagacatcggtgatctgcgcgcccgcgtcgcgcgtctcgacccgctcgccgccgcgcagtgcgccgcggctgtcggcaagcccgttcaagcgcatgaattgaaccgtcagctggtcggcattcttcggggcgaccacgtggtcgccgtcgccctggacgatcagcgcgggcatgcccggatacgcggcggcatcgaccagcgcatcgacggctgcagccgggttttgccgcacgccgcgccgcatcacatccatcgcggtaatgccggaattcgcctcgccgagcgcggggcccgagtgcagcgccaccgccgcgaagcggtcgggatgatgcagtgcaagaagcgacgcaaggcccgcgccggccgacagtcccgcgacataaacacgcgatgcgtcgaaaccgtgttcgtcgacgagcgcgtcgacgagcgacgccaccgcgttcgcctcgccgcggcccgcgcggtcggtatcttcataccagtgccagcagccatgtgcatgcgcgcgcagcgactgctccggatacagcaccgcgaaaccatgcttgtcggccagcaggttcatccgcgtgccttgcgcgaattcgtcgacggactgctggcagccgtgcagcatcacgacgagcggcatcgcgccacgccggcggccgggcggcacgtagagcccgtaagcgagatgctggacgaggcgcccgagcgcgggtgccatcggatgttcgccacgcgtccattcgcctgccgcccatgcggccgcgcgcgggcgcacgcgcgattcgcgcggcggggacagatccgatacggcgggagacgccgctgcctcgagtgcgtcgcgtgtgatgcgctgcgcatcgcgcgccgcgcgtttggcggccggagacagcatgcgtttcatgccgcccagccacaccttggtcagacttttggtcatcgatcgggctcgcagtcaggaaaaataggggcaccacagcggatgcagcgttcgactttgtgcaatgcaccataacattgtttccggatttttcctgcacgcggatatttcccggccgcgcaaaaacggggctcgggcgcacgcggcgctatactggggcttcgccgcttgtatccgttgtagtcgttctttccggctcgcgcgttgatttaagcatcttccccgccttcgtttgtcccttcccgatgttcgacctgtcgtctcacctgtggatcatgatcaccgcgttcggcggcgccggcctgaccttgccgctcgcgatcacgatcgccgtctggctcgcgctcggctactcgtggcagcgcgcggccgcatggctcggcgtgctcgcggccgcgatcggcgtggtcgcgctgacgaagatcgcgttcctcggctggggcatcggcatccgcaagtgggatttcaccgggttcagcggccatgcgatgctgtcgacgtcggtttatccggtcgcgattttcctggcgctgatccgcacgcgcacgccggtgcggatcgccggcatcgcgctcgggctcgcagccggcgtcgcggtcggcgtgtcgcgcgtcgcgctcgacgcgcattcgccgtccgaatcgatcaccggctgtatcgtcggcgcgatcgccgcgctcgcgttcatcgcgggttcgtggcgcgcggtgccgcaccgctggtcggtgcccgcggtcgtcgcgagcctcgcgctcgtcaccgtggcgctgcacggcatcacggtgccgtcgcatcgctgggtcaccaaggtggcgctgcagctgtcgggccacgagcgcccgttcgtccgcgcgcgctggaaggccaacccgaactaccgccccgcatcgcagccgtcgtcgctgcagcgcacccagtcgtcgtcgcagacgctccgtacgtgaccggccgcccggccggccctcctttcaggtctgaccattccatgcgcgccgtcgcatgtgcggtatgtcgagcgttataacccgccctatattacgattacggtttccacccattcgaacgaactcgccatgcgctcaaccgtccgtccgcttcgccgcaccctgcttcgcctgctgccgatcgccacgcttgccgccggagtcgcgttcagcgcgcccgcttccgccgccgatgaactcgtcgtgtcggccgccgccagcctgacgaacgcgttcaaggccgtcggcgatgcgtacgagaagcagcatccggataccaaggtgctgttcaacttcggcgcgtcggacgtgctgatgcagcagatcgccaagggcgcgccggccgacgtgttcgcgtcggccgaccagaaggcgatggatcgtgcggccaacgaaaggtgatcgtgcccggcacgcgtcgcgatttcgcggcgaactcgctcgtgctgatcgtgcccgcggacagccacgcggccgcgccgacgtcgttgaacgacctgaccgcatccggcgtgaagcgcatcgcgtacggcgacccggcgtcggtgccggtcggccgctacaccgaaggcgcgctgcgcgcggccggtgtgtgggacgccgtcagcgcgaagggcgtactggcagccaacgtgcgccagagcctcgattacgtcgcacgcggcgaagtcgacgcaggcttcgtgttcggcaccgacgcggcaatcatgccgggccgcgtgaaggtcgcactgacggtgccgaccaaaaccgccatcacctacccgatcgccgtggtcaaggacagccgccacgccacgcaggcgcagtcgttcatcgacttcgtcgcgtcgccgcaaggccaggccgtgctgtcgacgttcggcttcaagcccgcgggcaagtgagcgtaacgcgatgcaagacgcctgggtcccgctgctgctgtcactgaaggttgccggctgggcgaccgcgctcgacatcgtgctcggcgtcgcggccgcgttcatgctcgcgcgctggcgctcgccgctgcgcgacgtcgtcgattccgtgctgacgctgccgctcgtgctgccgccgacggtgctcgggtattacctgctcgtgctgctcggccggcgcggcgtgttcggcgcgtggctcgacaggctcggcatcgagctcgtcttcacgtggcaaggcgcggtgatcgcgtcgatggtcgtcgcgtttccgttgatcctgaaatcggcgcgggcggcgttcgaaggcgtcgatccgcatctcgaacgcgccgcgcgcacgctcgggctcggcgaagcggcggtgttcttccgcgtgacgctgccgctcgccacgcgcggcattctcgcgggcgcgctgctcgcattcgcacgcgcgctcggcgagttcggcgcgacgctgatgatcgcgggcaacctgcccggccgcacgcagacgctgtcggtcgcgatctacgcggccgtgcaggccggcgacgacaacacggccaacttcctcgtgctggtgacgtcgatcacctgcgtgctcgtactgctcgcgaccggctggctcgtgccgtcgcgtgcccggcggagccagctgacatgacgcgcctgcctcgcccatcgtcttgcgtggccggccggcttccgcggaggcccgcatgagcctcgtcgtcgacatccgcaagacctacgcgaatgccgagcgccgcttcacgctcgacatgtcgttcaccgcgacgatgcagcgcgtcgtgctgttcgggccgtccggcgcgggcaagagcatgacgctgcaggcgatcgccggcctgttgtcgcccgacgaaggcacgatcgtgctgaacggcgaaccgctgttcgacgccgcgcgccgcatcgacgtgccgacccgcgaacgccgcgtcgcgtacctgttccaggactacgcgctgtttccgcatctgaacgtgcgccagaacatcgcgttcgggctcacgccggggctgcgcaacccgcgcgcaaaagcagtgccgccggaagtcgcgtactggctgcaagcgttcgatctcgaggcgctcgcagggcagtatccgtcgcaactgtccggcgggcagaaacagcgcgtcgcccttgcgcgcgcactggtcgcgcagccgcgaatcctgctgctcgacgaaccgttcgccgcactggacggcgcaatgcgccagcgcatgcgtcacgagctcgccgagctgcaggcgcggctcgacatcccgatggtgctgatctcgcacgatcccgacgacgtcgccgcgttcggcgaccaggtcgtgcagttgagcgaaggacgcgtgcaggcggcgacgccgcacgccgagtggccgacgcgcgtcgcttgagtgcgcgtggccgtggtcgtcgtggcaagcacgttggagcctgagagaagccgccagcagcggcacaagcggaaagcggaaacgaagccggcgccgtaccgatacagcggcgacgccggcttcgctccgtccgtcacacaaccgccgaagcgcgccggtacgccgccgctcagcccgtcaccgcaagaatcacgctcgacgccttgaacagcgcgatcgcgcgccggccggcaccgagctgcagcgcatcgacgctgtcgttggtcacgacggccgtcaacgtcccgccgccgtcgagcgccaatgtcacctcgctgttcaccgcgcccgctgcgacggtttccacgtggccgcgcagctggttccgcgcggacaccttcaacgcgtgctcgccatcgtcggccgcgagcacgacccaggacgccttcacgagcgcgcaggcatccgcgccaacctgcaggccgagcgcatcggcgctctcgtgcgtcagcacggcaacgaccggctgtccgccgggcagcgtgagcgtgacctcgtcgttgacggtgccgcgcacgatcgccacgaccttgccgaacaactggttgcgcgcgctggtcttcatcccgatccggccgatcagcgcccagtcgacgtcgaacccggccacggccgcgctcgcggcctcgatgaaccggcgatgctcgcgctcgatcgtgcggaacgcggcgatcaacgacgtcgcgcgcggcgtcagcgtcgtgccgccgccgcccttgccgcccgtcgaacgcgcgacaagcggttcgcccgcgagattgttcatcgtgtcgacggcatcccacgcggccttgtagctgaggccgacggccttcgccgcgcgcgtgatcgacccggtgtcgccgatcgccgcgagcagcgcgatgcgcgtggcgccgccgagcgtctgctcgccggcgcgcagccacagctcgccgcccagttcgagcggttcggcggacggggaagaatgcggtgcgtcggtcatcgggatacgtgcgggaattggaccggagccggaatcgggccggaatcaggcggccattatagtcggcgcgtgccgctcaacccggcttgccgtcgagcttcggcggccgcaggctggcaagcagcgtctcggcgtcgcgcgccgcgcgctgctcgagcgccgcgccgtagccgcgcacgaaaccgagctggtacggcggcgccgccagtttctcgagatgatgcagcgcgactatcgtgtcgttggcttcgccgagcacgctctgcacgcgcgcgagcgtcttgaccgtctcggtgcgcgtgcggcgcgacgccagcgacgcgaagaactcgagcgcatagcgcagccgcttcgcatcgatccgcacctggtggcgcgcagccgtgtcgagcgacgtgagcgatggcgacgcgtacagatggccgaacagccgccgcacgcgcttcgtcgcgtggcgccgcagcgagggtgcgtcgccgtcttcggcgtgcggcagcgcaagcgagcccagccattcgagccagccgagcgtcagccgcgcgtagcgggccgaatgcagcgcctgccgcagctcgccccgtgccgcgacgcactgcgcgcgcggcgtcgagcgtgccgttccattcgccgtcgccgccgtcggctgcgatcagcgcgggcaggctctcggtcgcgaacacgtcccagtcgcgcaccgtgccgagcagcgcggcaagccagtgcatgtccacgccgagcgtgtcccgccactggcggtcggcaaagcgcgggaagaagcgcatcagcgtacgcaggcggcgcagcgcgacccgcatctggtgcacgaattcgggatcgtcgtactcgagcacgccgccctcgttgccgagccattgcgcggtgatgtcgccggacaacgcgaacagcgcagcgcgctgcgtgcgcacgccggtcaggtcgacgggctgcgccttgacgggcccgctggcggccggctcgtccgcacatgcgcgatcgatcacgctcgtcagctggacgaatgcgggccacgcgccgctcagttcgcgcgccgcggcaaacaacgcgtgcagcgcggccgtgcgcgcggcccgggtttcccagtccggcgcggcaagacgcagttcgacatagcggcgcggcggctcgccgccgcgatgcaacgtgacgtcgtcgagcgtcatctcgaccacgacgccgctgtcgtcggcccaccgcccgcgccgccgctcgctgacgaggcgcagcgccgacgattccgtctgcatgccggcctctgcgcgcccggtcgtatccggcgcgacgccgtcgacttcgcctgccgcctcgggtacgggcaacggcatcgcgacgacgatgcccgcatgctccgcgtcgaacagttcgcgcatcgtgaccccggcgcaaacacctttgtgcgcgacgcgacgacccgccttccatgcgcattcgactcgacccacgtccaccagcttgcgccggggctcggctcggcctcctcgatctggcacggctcgatcgtcacgcgctcatggccgcggcgcatccggacctgcgggcagatccgccacgcgcgcacgagttcggcaccgaaatcacgctgcgtgccgcgggcgcgacccgcagccttggccggccacccttccagcgacagcgacaacacgatttccagcacacgcgacatggaggctcctgcacatgaagaagcgccggcgggtcttccgatcgcgccggcgtcgtccgtgaagctgcttccatagtacacgccgcaaaaacgggctggcaacgatctggccctgtcgccctgtcacaggtcaaacggcgtactgcgcgaggccgttgccgaacgaccagttctccttcagcacctcgacgagactgatgaagacgtcctgctgccgcacgccgggctgctgcgcgaggttgtccgcgatcgcccggtacagcgcgcgcttctgctcgagcgtgcgcgtgttgttcgcggtgatctggatcatcacgagatcgtcgctgcgttcgatgtcgaggtagtggcggccgtacacgaagttctcggccgcatgctcggtgacgaccatgaagatgtcgtcctcgggcacgttgaacgcgtgcatcagcgcgcgatgcacgccatcgacgagcgccgcgcggtacgcggccggtttgccttcgcggactgcgatacgggtgaatggcatggtcctgctcctgtcggtgaagttgacgttgacgaacggaaacacagcgtcaggttaggcgcgccgaactataatgaacagtcattgatgaatatttcatccatttacatcgaaaatgaaagtcctcgacctcgatgccgtacgcgcgttcgtgctggtcgccgatctcgccagcttcacacgcgccgccgatgcgctcggcaccacgcagtcggccgtgagcctgaagctgaaacggctggaagtgcacctcggcaagccgctgctcgcgcgcacgccgcgcgtggtcaagctggccgccgacggcgagaatttcctgccggccgcccgtgcgctgctcgacgcgcacgaccacgcgctcggcgcgatctcggccggcacgcaccggctcgcgctcggcgtcagcgagcatgtcgccgtgcccgacctgccggccgtgctcacgagcctgcatcggcaggacccggggctgtcgctcgaaatgcatctcggaacgtcgacgaacctgctcgcgcaatacgacgaacgccggttcgatgcggtgatcgtgcggcacgagccgggcgaagacccgccgcgcgaagacggcacgttgctgttttccgagccgctggcctggctcgccgcgccggactgggcaccgcgtgcaggcgagccgctgccgctcgcggtgctggccggcccgtgcggcgtgcgtgcggccgcgctgcgtgcactcgatcacgcggggcggccgtggcgagaacgctttacgggagggggtgtcgcggcggtcacggccgccgctgcggcggggcttgccgtctgcccgctcgcgcggcgtcgcgccgcgcacgctggtcgacgtcggcgcgaaattcgggctgccgccgctgccgctgtcgcaggtcgtgctctactcgcgcgtgcgcgacccacgcgcggccgccgcgctgcgcaggtttgccgacagccttgcaatctcggcgtaaactgacgggtttcgccgccagcaatcttcagaagaattccaatgaagcccgaagcccgcaagcacctccgtgccaacctgctgatgctcgccgccgccgcgatctggggttcggctttcgtcgcgcaacgcctgagcctcgacgtgatcgggccgttcctgttcacggggctgcgcttcctgctcggcgcgctggtgctggtgccgctgctgacgctgaacacggcgtcgcgcgcgcagctcgcggcgatccgccgtgcgccggcgctgctgctgccgggcctcgcgctcggcgggctgctggcggtatcgatatcgctgcagcagatcggcctgcagtacacgcgcatcgccaacgcggggttcatcagctcgctgtacgtcgtgatcgtgccgctgatgggtgtgttcgcccgtcaccggatcggcacgggcacgtggttcggcgcgctgctcgcggcgatcggcctgtatttcctcagtatcgacgagcacttctcggtgctgtacggcgactggttccagctcgccggcgccgtgatcatcgccgcgcacgtgatggccgtcggtcatttcgcccggcgccacgatccgctcgtgctcgcgttcctgcaattcctcgtgtgcggcgtggcgtgtctcgcggtcggtctcgccgtcgagccggtcagcggcgccgtgctgcgcggcgcactgccgacgctgctgtacggcggcctgttgtcggtgggcgtcggctatacgctgcaggtcgtcgcgcaacgcgacgccgcgcccgcgcatgcagccgtgatcttcagcatggaaggcgtgttcgcggcgctcgccggctgggccgcgctcggcgaaacgctgacgctgcgcgcgctcgtcggctgcgcgctgatgctggccggcctgctcgcgtgccagttgctgccgaacggcgacgcccggaaaaaggacgaggacgcactgccggcgtgacacgcaccgtccctataatggcggttcgcgtgataaccacgccaaccgcttccgacaggcccgctccgtgacgtccacttccgtcgatcccgccgccgacctgctgcgcgaacgcgcagcgcactacgccacccaggcggcgctgttcctgcgcgaccaggcgctctccaccgcatcgcacgacctgcgcagcccgctgaatgccatgcatagctgggcatacgtgctcgagcgccagctcgccaacgccgatccgaacctgcagcgcgcgctcgcgggcatccgcaccgggatcgaccagcaggtcgcgctgatcgacgacgtgctcgatgcgccgcgcgcggaaacacgcacgctcgcactcgcgccgcagccgttcgcgctgcgcgcgctgctcgacgacacactcgcactcgtccgtttcgcgctcgccgacgcacgacaggtcacgctcgacgcgacgctgccggacggcgaaccgtcgctgagcgccgaccgcgaacgcatcgcgcaggcgctctggacgatgctgacgatcgcggtcgaagccagcgccgccggcggccgcgtgacgttcgcgtgcgcgcgcgacggcgtgcagttcaccgcgcgcgccacatgcaccgtcaacgccgacacgctcgtcgatcccgcgcagccgcacgcgttcgaatcgttcgcacgacgcgagctgctgcgcgagcgcgacgcgaagcgcgtcgcgtgggcgcttgcgctttgccagcgcgtcgcgctcgcacacggcggcacgttctcgcacgacgcgttcgccgatggcgcaaccgccaccgtcacgttctccgtccccggcgaggcgccggtgtaagccagcggccgcccgacacattacgaattcctttctggctctatactgacgggcctgtcataaccggagtgattctttgttacagatcttcgcgctcatcggcgcgttgttcctggtggccctgaacgggttcttcgtcgcggccgaattcggcctggtcaaactgcgcgccacgcgcgtcaagacactggcccgcaagcacggcctgcgcggccgcatcctcggcatcgtgcacggccggctcgacgcgtatctttccgcgtgccagctcggcatcacgctcgcgtcgctcggcctcggctgggtcggcgaaccggcgttcgcgcaactgcttaccccgctgctcgacctgatcggcgtgcagtcggagcgcgtcgtgcacctgatctcgctggtgttcgcgttctcgctgatctcgttcctgcacatcgtcgtcggcgaactggcgccgaagtcgatggcgatccgccagtcggagaaggtcggcctgtgggtcgcgctgccgctctatgcgttctactgggcgatgtacccggcaatctgggtgctcaacaacagcgccaacgcggtgctgcggctcgccgggctgtcggccgaccatggcggcgacgcgcactactcgaccgacgaattgaagctgatcctgcgcagccgccgcagcacggccggcaacaccgcgcagccggcgcgcggcacgtacaccaacgacgagtggaacacgctcgcgcattcgctcgatttttcgtcgatgaccgtatcggacctgatgcggccggcccatgaaatgatcggcctgcgccgcgacctgccgctgcccgacaacatggagatcgtcgcgcggcaccgcttcagccgctatccgctgttcgaggatgcgtcgcgtgaacaggtgagcgggctgatccacctgaaggacctgctgctcgcgcgtcacgcgggcgccgcgctcgaagacctgtccgactacgtgcgccccgtgcagtacgtgaagcccgacacgccggccctcgacctgttccgccgtttccgcaagggcgcaccgcacttcgcgctggtcggcaacaagggcgagaagccgatcggcttcctgacgctcgacaacctgctcggcgcgctggtcggccagatccacgacgagttccgccagggcgacgccgactggagccgcctcgacgacggcacgctgatgggcaagggcagcctgcccgtcgtgtcgctcgaacaggcgctcggcatcgacatcgacgaaggccgcgcggaatcggtcggcggcctcgtgatccaggcgctcagcgacctgccgaccgaagggcagcgcgtgtcgttcgaccgcttcgacgtcgtcgtgaagaagatgaacgggccgcgcatcgtgctcgtgcgcgtctacccgaagatcgcgaaagaggccgacgaatgacggccgcgcgtggctgccgccggcgcacgcgatgaacgcgacgctgccgcgctgctgcgtgatcacgcccgagccggcgtccgcgtcggccgccgattgcgcggcgttcctcgaccggctgtcggccgtgctcgcacgcggcgagacactcgtgcaactgcgcgtgaaatcgctcgacgcagccgcgtttgcgcggctcgccgccgcggcgctcgcgcgctgcggcgcggccggcgcacacctgatgctgaacggcccgatcgatgcggccggcgtgatgcggctcgacggtgcaggctggcatctcgacggccccgcgttgcgcgccgccacgcagcggccgttgccggccggaagatgggtgtccgcggcctgccatacgcgtgacgacttgctgctggccgcaggcgccggcgcggatttcgtcacgctgtcgcccgtgttgccgacgctcagccatcccggtgcgccgacgctcggctggacgcagttcggcacgctggccgccgaggccgcgatgcccgtcttcgcgctcggcggcatgaaacgctcccacctcgacgatgcacgccgccacggcgcgcacggcatcgcgggcattcgcgggttctggtagtccgggatttccggcgacgcaaccgggcgcagatgcgcccggccgttcagacattaccgcctcacgtcgtcatgcgttcaggttcgggtgccttccgcgccacgcgccgtcgtcgatgcgacgcgcatcgtgcgtgagcgcataccggttgacgtcacccgtcagccacgcgacgagcgagtacggcggcaactcccttcatcgacccggtcgcgcgcacgcgccggcgtctcgaacacgacccgccctctcggcgcatcgaacggcaccgcctcgggcgacaggttcaacgcgatcgtcagcgtctcgtcgtcggcgagccgccacgacgcaagcagcgcgtcggcatcgccgtcgccgtccgacttcagcgcacgcgcatcctgcggccggcaatcggacaacctcggcgcgatcagcttcgcgcgcaccgccagcgccgactgcacgaaatgcgcgcgatcggcatcgcgcgcggtttcgtcgaagatcaacgggatctgcggcgtgagcagcgacagcgcaagcgcggccagaccggcctcctgcccgtggtcgccctgcccgctgtcgcgccacgcgccgtcggacagcaccagcgacgtcaacgacagcccgctgtcggccgccatgccctcgcccgacccggccggctggaatgcggccccggccgcggtcagcgcgcgggcgagcgtgtggatcgactgatgcgcggaaatgccttcatgagccgacgtgtcgcggcccgtcagccggtgcagcgcgcgttcgccgcacccgttccactgcgcatcgaaatgggtatcggcaagatgcgcgggatgccgctcgctgccgagtacgagatggatgagccggtcggccggcaccgccgcgcgcacgcggtctgcgatctcgcgcagccacgacacgccgatccggtcggcttcgcgcaggcgcagaccgtcgcaacggtactcgtcgatccagtacagcgcgttgtcgcagaagaaatcgcagacttccggatgatcgagcgcgagcggcgacgcctgcagcggatcgtcgcgcgtatggaagaacggcgccgcgtagtggcgcagcgcatcggtgccgctgccgaagcgcgcgtagtcgagttccagcagcaccgcgagaccgtagccgtgcgcatcgtcgatcagcgctttcagcgcgtcggggccgccttcggccgcgagcggcgcgaacggcaggctgtcgtgcggcgacgcgagcagctccagcgcggtcacgcccaggcgcgcgagttgcggcaggcgccggcgcacgccgccgaagccgcccaccgcgtgcgggcgaatcgcatagagcgagatgtcttcccatgcgcgcccgcgccagaacgtgttgcgccacgtgaacgcgcgcggatcgacgacctcgctcgggccgttgagcccctcgggttgcgagcgcgatgcgggatcgggaatcgacaccgtatcgtcgaggcgatagcggtaaagcgcccccgcgccgcaatcggcaaagacttcgaaccagtgcgtgccggcggccgtcatcggaacgagcaacgggccgaaaccggtatcgagttcgagctggacctgcgtgctgcccggtgcccacacgcgaaaatgcgtgcgcggcgtcgcgcagagcgcgccacagggctgtgcgccgaacggcaggcagtgaatgtagtgctgcgcatacgggtcgtgcggacaatcggacatcatgcgctcctcgtgcgtaccgagcggcatggccgcgccagcggcgcggcacatcggggcccggcatgcgacggccaggcggggagaaacgagtatgcgccggattcgccatcgcgatgcaacgtccccggacattattaaatgcgaatcgaccctggaaaacccgcggtccggcaagcgccggcgaggcaggtagcccgcataccggaatgcctgctcgccttgttgcaccggccgtgcacgcttacgctctgcgcgatgctcgtggacacgccgtccgcgcccgacccgaggaacccgtcatgtcgcttcccgccagcgccgccaaattcgatccggcacgcgcacacgaatacgccgagcaatcccgcatcgcactcgccggctacgatgcctgccatgaactcaccgcgtgcatgctcgcgtcggcaatcgctgcacccgatgcgcggatcctcgtcgcgggcgcgggcggcacggggcaggaaatctgcgtggcggcctcgctcgagccgggctggcggttcacggccgtcgacccgtccggccgatgctcgcgctcgcgcgctcgaacgtcgaggccgcgggctgcggcgcgcgaacggcgttcgtcgaggacggtgtcgatgcgttgcccgatacacccgcgttcgacggcgcgacgctgatcggcgtgctgcatcacgtcccgggcgacgaagcgaaggcggcgctgctgcagacgatcgcgcggcgcctgaaacccggcgcgccgctcgtgctcgccggcaatcatcgccgctacgcggaccaccctcgcctgctcgacgcatggcagcaacgctggcgcatgaaaggcgcgacgcccgacgcggtgcgcgcgcaactcgcgaagatcctgcagggcgccgatccgcccgtgtccgaggaagccgtgttcgccctgctgcgcgatgcgggcttcgatgcaccgctgcgctttttcgcaagcctgttctggggcgcgtggatcgccgtccggcgcgcgtgatggatcggggcggtcggctagacgcggtcggctagacgcggtcggccagacgcgtcgcgccacgtcgcgcgacgcgtttcgcttgtgcgccacccgcgctgggtatgatgtcgttcccgcccccacttccggcgtcgacatgctcaccgtccatcacctgaacaactcgcgctctcagcgcgtgctctggctgctcgaagaactggaggtgccgtacgagatcgtgcgctacgcgcgcgacccgaagtcgatgctcgcaccgcccgcgttgcgcgcaatccatccgctcggcaagtcgccggtcgtcaccgacgagggccgcacgtacgccgaatcgggcgcgatcatcgaatacctggtcgaacgctacggcaacgggcgcctggcgccgccgcccggcacgcccgagcggcacgactacacgtactggctgcactacgcggaaggatcggcgatgccgccgctgctgctcaaactcgtcgcgctgcggatcgcgcatgcgccgatgccgttcttcgcgcggccgatcgcgcgcaagatcgccgagacgctgcagtcgggcttcgtcgatccgcagatcgcgctgcatctcggccatgtcgacggtgtgctgcagcgcaccggctggttcgtcggcgacagcttcagcgcggccgacatccagatgagctttccgctcgaggccgcgaccgcgcgcggcggcgacggccggcatcccgcgatcgcgcgctttctcgacgcgatccacgcgcggccggcataccggcgcgcgctggagcgcggcggcccgtacgagctgctcaaatgacgcggcgcacgaccgcggcccgcgtcagctcagcaggccggctgccacgttgatcgacagcccgagcacggccatgttgaagtagaacgacaggatcgactgcgcgagcaccgagcgccgcgcggagcggctcgccagcgacacgtcggccgtctgcgacgcgaccgcgagcgtgaacgcgaaatacaggaaatcccagtaatcgggttcgggattgcggtcgggaagcgcagcgcgcggtcgttggatggcgagccgtaatagaggcgcgcatagtgcagcgtgaagatcgtcgggatcaggaaccacgcgccgaacagcgtcgcgcccgtaatcgcgtagtggctgagccccgcgctgaagcccacgctcttggcggtcgcgagttcgatcgcgatcgcagccacgctcgccacggtcgcgaagcacacgacggtcagcacggtcgtcgcgttttcgtcttcgcggatcgcgacttcacgcaccttgtgatgatgcgcggtgaccatgcgcacccacatcagcacgagatacagccagaccgcgcaatcccagccgatcagcgcccgcgcggccggacgcagcggaaacggcagcagcaccgcgcacagcacgccggcgatgaacgccgcgaccatgcgcggccggttgcgtaatacctggggatagaacgtcatcgtgtgattccgaaagcagatggaaagggttcggccgacgcgcgggacgccccgccgcgccgcaccggcgggtagcgccccgattatcgtcattccgtcgtgacgtggcgatgggcgcgagcgcctaagataatgggatgactgccaccgccccctctgccaccatcccgcgaatacggccggccgtgacttcgtcgtcggcgacctgcacggctgcgtggatgtgctgcgcgcgctgttgcacgacatccgcttcgatccggctcgcgaccgcctgttctcggtcggcgacctcgtcgaccgcggccctgcatccgaaaccacgctcgacctgctcgaccgcccgtggtgccacgtcgtgcgcggcaatcacgaggaagtgttgagcctcgtggcgcgcggcaagctgtcgcccgacgcgtggcgcgggatcggcggcgactggggcgccgacctgccggcggaacggctgcacgcgcacgcggcgcgcgtcgacgcgctgccgctggtgcgcgtgatcggcgacggccccgggcgcttcaacgtgctgcatgcggaattcttcggctcggacgccgatctcgacacgggcagctattcgcacgacgtgcgcgaacggctgatctggggccgcgatctcgtccaggggctcgccgatccggggcagcaggccgggctgtcgctgacctgcaccgggcacacgccggtgcgcacaccgcagcggatcggcgcgcagtggttcatcgacaccggtgcgttcgcaccggccgggcggctcacgctcgtcgagccgcgcaccgggcgcacctggtcgatgacgcaggccgaggcgcgcgaacgccacgcgggcgactggccgctgccctgatgcccgcgagcgcccactagccgacctggttcagttcgaacaccgcatcgacggccgagccgttccagttgtattcgaggtaggccgcgtgatggcaatcgcgcagcagcgcggtgcggaacgccgccaggcactcgccgcgcgggtcgcgcaccgacggatagacgatccccgcaccgccggcattgcgcaccgcgcggccgagcgcctgcccggcgctgtaatcgagcgggtgcagcaaggccggatcgcgtttcggccacatgcgcacgtcagccacgtcgccttgcgcgatcaccgtatagagccgcatctgctggcgcatcggcggctccttcgtcgccgccaggaacagcgcgctgtgataacgcgtttcggcgatcgccgtatcgcgcgagcgcgcgcagtagaacacgccgtagctgccgtcggaaaaacggctgccctgcggattcaggtgcgtgaacgcggccatgatcggccccagcccagcccgtagcgacgttcggcgggcgggacgaggtcgagcgtgccgacttcgttgcgaatgcggtcgttggtcagcgattcgagcgcgtaaagcgcgtcgaaatcgtccgccgacgcaacgcggtcgaacaggttgattgccggaaaacgggtggggatcacgcgataggcaggcgcccagtcgaccgcggtcgtgggccattgttgtgcttggatcggcatcgtcacgcccagccacctcgcatcgcgtcgagatattgccggacggcgaccagatcgccgacgttgccggcgagcatccggtcgagtgcgcgcttgccgccgaacggcgccgcgtcgttgggccgcttgacccacgcatcggctgcggccggctgcggcagcaggatctgcaacgccttgtagatgccgagcagcagcgatagccgctcgagcgtatcgcgcggtagccgcgccgattccggcgcggccttccacttgaagaacgtcgaacggccgggcgacccgagcagcacgatctgttcgtcgatcgtcagctcccagtcgcgcgcgatgttgaaaaacgcacgcaggccggccgccgacatctgcgcgaccgaggcctgcggcggggaggaatgcgattcgtaggcgggctgtgacatgatcgttagtctcgaaacgaatttactaacaagattagtccattttcgtatttttgcaagggtcggcacccggcgaccgattcacgcatccggcgaaacgatatttttgtccattctggactctgattttattttctgcgttaatggccgtgcggacaccgcgcgcagatgcggctcgggtccgtgaaaccgtgtcgcacagaaccggaagcaccccgccaaggaacgcaccatgaagagactgattgccgctgtttcgatcgccctgctcgcggtatccgcaggccccgccgtcgcgaaggactggaccaccatccgcttcggcaccgacgccagctacgcgccgttcgagtcgaaggcgcccgacggcaagctcgtcggcttcgacatcgacctcggcaacgagatctgcgcgcgcctgaaggcgaagtgcgtgtggctcgagaacgatttcgacgggatgattccggcgctgaaggcgaagaagttcgacgcggtgctgtcgtcgatgtcgatcacgccgcagcgtgcgcagcagatcggcttcacgacgaagatctacaaccagccgacgcggctcgtcgtgaagaagggctcgccgctgcagccgacggccgaatcgctgaagggcaaatcgatcggcgtcgagcagggcacgacgcaggaaacgtacgcaaaggcgtactggggcaagcaaggcgcgaacgtcgtgtcgtaccagaaccaggacggcgtgtacgcggacctgacctcgggccgccttgacgcggcgctgcaggatgaagtacaggccgcgatcggcttcctgaaatcgtcgcgcggcgcgaactacacgttcgtcggcccggagctcgtcgacgagaaggtgctcggcatcggcgccggcatcgggctgcgcaaggaagacaccgacctgaaggcgaagatcgacggcgcaatcctcgacatggtcaaggacggcacctacaagcggctcgcgtcgaagtacttcgacttcgacatctacggcggctgaaacggcgtcgcgcgcgtacgggcgccactcccgtcgcgcgcgtccgaccgcccctcctcaccaccggacggcaacggcatgacgccgtttgccgtcgcatcgaatgcatcatccgtcgcgcgcgcggcaagaccctcgcgcctcattcggattgcagatcaatcgttcgcggcgacgatgcccggcgcgaacggatatcgtgcggcttcggtcaataggcgaagaccgggcgtcgaggtaccggcgcccgagcgcacatgcccttgcgaatcgggttcgcgtgcaggaaagtaccgacccggcgcggatgaccggcaatcagccggatccgcctcgcaccgggcgcggagagatggcctgtcgatgcatgccggccggccgagagaacgacatgcgaccggcgatgctccacatcactgcgatcgcggcctgccggccgcggcgtgtggcgatcgatcatttttctaccccgtatcagtctgatggttgttccggcaaccggacgaggccggtgccccgacgatcaggcgacgacgctccgtgctcgccggaacgcggctgttgcgccgcgctccgccgccgcatccccgcggaccgtgtcctggccggtactgacaggattcgctgccgaaccggacggaccgtgcatcgtcgaccttcgcacgcccactttcgcaaggagcgggccagcttcgcgcgagcctgtccggacaaggggccggccgggcagcgtggcggccggaacgggtgccgaatgcgggaagttacgaaactgaaacacgcggcgcgcggcacgcgcgggccccgtggcggccctggcttgccggataaggctgaacaatgaagcacggcatttttaccgatggacggccggccattcacgccgattcaccacgcaaattcgcatggccgccgacgcgaaatgtttcatgcgctttacatgccgcaggcagcacgcgggccgcgggttgcccgcgcgatccatccgccggtaccgggccggccgggcgcacggctatactgcgaaaccggcgtgcgtcgtgttcgcatcggcgcctccggccggcggatgccgtgccgcacgacgacgccacacacaccgccccaccgcccgaacgatcgccccgccgatgatccgtaccctctatatcgcggaacgcgccagactgattcgcttcggtgtgtcgggcctcggttcgaccgcgctgcacgcgttgatcgcggccgcgatgttcgcgctgttcgacgcgacgcccgtgaccgcgaacgcggtcgcgttcgcctgctcgaccgcgttctcgtatctcgccaacacgctgtggagtttttcgtcgcccgtgacgtggggcaacttcatgcgctttctcgccgtcgcgatggtcggcctcgccgtgacgatgctgcttgcgcacggcgccgtgacgctcgggctggcacgcgcgtggagcgtcgtcgcggtcgtgctgtgcgtgccgcccgtcacgttcgtgctgcaccggctctggacctatcgctgaaccggctcacgcgtcgcgcgtgcgccgctcagccgacccgctgatgccccgcgtcgcccgacggcgcgccgtcgtgcccgccgttgtcgccgttgttgtcgtggtcgttcagcccgtgctcgatcatcatccggtagagcgtcacccgcgaaatgccgagttcggcagcggccttgttgatgcggtgatcgttgcgcagcagcgcattctcgatcgcggtgcgctcggcgagcgcccgcgcctgttcgagcgtcacgggttcggtttcgcccggcgtatcgagcccgagatcgtgcggcgtcagcagccggctctcggccatcacgatcgcgcgccgcacgcggttgatcagctcgcgcacgttgccgggccactcgtagcgccgcatcgcgtcgagcgcggccgacgtgaagccgctgatcttgcggccgctatcggccttgtacttctgcagcacgtagtgcgcgaggatgtcgatgtccttgccgcgcgcgcagcggcggctcgtggatgcgcagcacgcacaggcggtgatacaggtcggcgcgaaagcgcccggcctcgaccgcgccgtcgagatccacgtgggtggccgagatgatccgtacgtcgaccggaatcgattcctgcccgccgagccgctcgatcttcccttcctgcaggaagcgcagcaggctcgcctggctttcgaccggcatgtcgccgatttcgtcgagaaacagcgtgccgccgttcgccgattcgatccggcccgcgcgacgctggttcgcgccggtgaacgcgccgcgctcgtagccgaacagttccgactgcagcaggtgatgcggaatcgcgccgcaattgatcgcgatgaacggccccttgccgcggccggaacgctcgtgaatcgcgagcgccgtcagctccttgccggtgcccgactcgcccgagatgaacacgctcgcgtccgtcttcgcgaccttgcggatcgtgctgaacagctgctgcatcgcctcgcagttgccgatcatcccgtgttcgccgatcgacgccgcgtaggccgcgccatcgacgcgatcgagcgcggccatcccgcgcgcgtggccgagcacgtgcgaaatccactcgtacggcaacggaagggtcacgtagtcgaagcagtagctgcggatcagctcgcgcacggccgggccgatcgtgataccggcctgggcgatggaaatccagccgatcgacggctggctcaggcacgccttgagcgcgggatactcgcgcgacgtgaacccggagaaatcgaccagcccggcagcgacgctcacgccggacgtcatgttctgcgcggcgccggctgtcttcgcgacggagatttcccagcccagcccgcgcagttgcgcaagcaacggctcgtcgggcgaacgcatgatcacgaacagcttgcgtccatcctcgggcgcggtgacggacacatgcgtcatctcgggcgccgtgtgcccgtttgcgtcaggtgacctagcaaccatcgttgttccccgcttggcattggtatcgcgcgcccggctcgccgccgcgtgcgacgaacctcgatcgaaccgacatattggccgcatttccgtccgaataaaatcccccgtgcatgaatcgcgcgtgaggtggacagcgtcatcaacggtatatcgatgtggccggcgcgcggctagatgggtgttatcccggtggcgtgcgcggcgcgggcggtccacgggtggccgcgcgacgcgcaaagccgcgccggtgctggcgcacggagttcgcgggcgatgcggcaccgacaggatcggcccggccgcgcatgcgtgcgcggccggtcgaccggccgccgggatgcccgcccggccggttcgaattgatttcggtcaatcgtcagaggaagccggctgatgcaggaacgcaacatgctcggcccgatgccgcgcacgccggcgcagcggaggggtcaacggcccgatgcgagcggtgcaggcgcgttcgcacggccacggccggccggggtgccgccgtgttcgccgtaggcggcggcaagcgcgtcgacgcgcgcgagatggtgatgattgtcgtgatcccacggatggaagcccggccggaagaaactcagccattcgcctgcgatgcgcgggaacagcccgcggcgcggcccgtacaggaacgcgatcatccgcagcatgccgcgcacgtgatggccggcgccgcgatcgcgccacagcagcgtcgcctgcatcaggaacacggtcggccagaacgtcagtgtcgtcagcagatacacgccgatgcggatcaggtaacgacgcagccccggcgccatcacggtgttccacacgtcgaacgacacggccttgtgctcggtttcctcgagcgcgtgccagatccacatctgacggtagccctcgaccgagccttccaggcgcgtcgggtcgcgcagcagccagtcggcgagcatcgccgtgtagtgctccgccgcgaccgtgtgcgcgagctgcaccgaatgcggcagcttgcgcttcatgtagccgagcaccgcccacacgcgcttgtcgagcttgcgcgcgggcaggtggttcgcctgcatcagctcgttgtactcgacgtgctcgcgcgtgtgcatcgcctcttgaccgatgaagccgagcacctgctgcttcagtacgggatcgtcgatccggtcgcgatagttgcgcaccgaatccatgaagaagcgctcgccggccgggaacagcagcgacagcgcgttgaagaaatgggtcacgtgcgacccgaggccatgccagtccttcgcgcgttcgaccggcaggtcgaagcgcaggtcgcggcgcaccggcatgatcccggctgcggtggcggaagcggctgacttcatgttcatcgttctcctggttccggagcggcccggcgcgtcgtccgacgcggccggcgcgggcccgggcggcgcatcgcgcaccgccaaaatcttgacatcgacagctgtaaagataggccgcccgcggcggcgcgcgcaagccgcgcggtagatgcgcgcttccaaacagggcacggtcgaaaaggcggaaaaacggcgttcgaacggcgtccggacacggcgggattcgaacgcacgtgaccgcacgcgagccattcgcggcagtcggcaccgcatcgcagcggtggcccggaagcccgcgtggcgggcatttcacggaatccggcaacccggcgcggcatgcggccgagcaccccggtagcaccgattcatacgcgcgtcgcactcgcgcggtgcaacctcggtcgcggggcgggccggaaattcaaacgcgcgttccatttgcgttccgcgcgatcgcggccgcgacggcccgccgccgtccgcgatacgcgtgcgaccggccgaaagccacgagcggcggcccgcagcgcgctcgcctacaatagcggttttacccatcctttttcaggagaagtcatgtctgtcatcacgaccgaatcgggcctcaaatacgaagacctgaccgaaggcaccggcgacgtagcgcaagccggccagaccgtcagcgtccactacacgggctggctgaccgacggtcagaaattcgattcgagcaaggatcgcaacgacccgttcgcgttcgtgctcggcggcggcatggtcatcaagggctgggacgaaggcgtgcagggcatgaaggtcggcggcgtgcgtcgcctgacgatcccgccgcaactcggttacggcccgcgcggcgcaggcggcgtgattccgccgaatgcgacgctcgtgttcgaagtcgaactgctcgccatctgacacggcacacgagccccggctgacgccccgccccatggcacaccttccgtcccccaccgtcgagctgcaacgctacgacgcgctcgaagcgtcggacgtgcacgactttcaccagatcgtgctcggcatcgacggcgcgatggtgatggcggtgaacggcgtcagccagcgtctcgaccggcaccgtgcctggctggttccggccggcgcgcgccacgattacgcgggcctcggcgagaatcgccagctcgtgctcaatcttccctcgcgtcactcgcggtgccgcagcggctgttcgacagcgcgcgcgccgtggcaatcgatccggccctgacgtcgctggtcgcgcagatcgcggcggcggcctcgcaattcgaagcgcctgccaccgacgcgccgcacgcggccgcgcaccgtttccagtggcaggccgccgcccggctgtgcggcgcactgctcgacgaacgcgacatccccgcgcccgcatcgggcctcgatttcgcgcgcatcgaccgctggctgcgcgcgcggctcgccgagccgctgcgcatcgccgatctcgccgcgcactgcggctacgggatgcgccgctttcatcaactattcgtcgatgcgttcggcgaaacgccgcatcgctacctgcagcggctgaggctcgacgcggccgtgatcctgctcgcggacggccggtatccgctcgtcgatatcgccgggatggtcggcttcgcggatcaaagcacgtttacgcatgcgttcacgaagcgcttcggcgttgcgccgggacgctggcgcggcgagcggcattgaacgcagccaaggttccgcgctgagcgcgcgtcgacacgggtcgtagcggcacggtcgggcacacggcgctcacgtcggccagcgcagcattcttcgctcctgcttcgctcctgcttcgtccctgcttcgtccctgcttcgtccctgcttcgtccctgcttcgtcccgctcgccgccctgctgcttcgtccccggcgcttcgacgcttcacgccccactgaaacatcgccggccggccgcgccctacgattggcgcatggacacgaccatcccctcctccaccttcccgcccgcgctcgcccgcgtcgtcgcgaccgtcagcaccggtttcgtcgtcacgcagctcgacgtgacgatcgtcaacatcgcgctcgcgcatctcgccggcgacctgcgcttgcccgtcgccggcctgcagtgggtcgtcgatgcgtacacgctcgcgttcgcggtactgatgctgtcgggcggcgcgctcggcgaccgcttcggcccgcgccgcctgtacatcgccggcctcgtgctgttcgcgcttgcgtcgctcgcgtgcggcgccgcgagcgcgcccgcgatgctgatcgcggcgcgcgcactgcaaggcgtcggcgccgcggcgatgctgcccaattcgcttgcgctgctcaacgacgcgtgccggcacgacccgcgcctgcgcgcgcgggccgtcggctggtggacggcggccgggtcgatttcgatcgcggccggcccggtcgtcggtggcctgctgatcgcggcgtggggctggcgcggcatcttcctcgtgaacctgccgctgtgtgcggccgggctggcggccgcctttgcatggatacctgcgcgccgtgcggcggcaacgccggccgcgccatcccgctccgtccgcgcactcgacctgcgcggccagttcatcgcgatcgcgatgctgaccgcgttgaccggcgccgtgatcgaatggcgtccgctcggcttcacgcacccggtcgtcgccggcggtttcgcgctggcggcgctcgccgcgctcgcattcgtcgcggtggaaacgcggacggccacgccgatgctgccgctgtcgctgttccgccatcgcacgttcagcgcggccgtgctgttcgggatctgcgtgaacctcacgtactacggcaccgtgttcgtgctcgcgctgtacctgcagcgcgcacgcggcgaatcggcgttgcaggccggcctcgcgttcctgccgctgacgggcggcttcctgctgtcgaacctcgcgagcggccgcgtcgtggtgcgtcacggcccgcgcgcgccgatgctggcgggcgcgctcgtcgccgcgctcggctacggatcgctgcacttcatcgacgcgtcgacgccgctggccgtcctgctcgtgccgttcctgctgattccgtcgggcatgggtttcgcggtgccggcgatgacgaccgccgtgctcgcgtcggtcgcgcccgaacgggccggcatcgcgtcggccgtgctgaataccgcgcggcaggccggcggcgcgatgggcgtggccgcgttcggtgcactcgccggcggcggcggcgcggcgcaggtcgtggacgggttgcggatcgaaacggccgtgtcggtcgcgctgctggtcgccgccgcgctgctcgcgacgctggtgcggcccgatgcgcatcacgacgcatcgtccgtgcgtcaggccgtgccggcggccgattgaacggctgcggtcatgcgtcgccggggtcccgctggatcaggtgacgccacggaaacacgttgtccttgaagtgactcacgtaaccgccgctgccggcctggatcaccatgaacgacagccgcggatgcagcgcctgcagcgcttcgagcgcttcccggtcgagacaggtgtttctcagcgtcagcgtgcggagccgctggccggcgcgactcttcagcaggcgctcgtaggcgtcgaacgacgtcacgctgccggcggcgcgctcgcgtttccaagtcgaatgcaaggcggtcgactcggagaaatcgagccagccgagcgacggcaggttgtcgcagtccgccagatggtcgatgaactgctgcgtgtcgtctccgccgccgatgcgcagccgctcgagatgcgcaagcggcacatcgaagaagcgcgcatcgggcgcgttcggcaccgtcagctcggcgagaaacggcgccttcgcggcaaagcgggcaatctcgccgccctcctgcatgatcaggtcgcgacgcacgatcatcgactggttgtgatcggccggctcggtcggccgcacatacagcgagcgcagcatcgggaagcgcgcatccgaatcgagcagcggcccgaaatcccattcgcgcgtgccgttcgccccttcgtcgatgccgctgaacgcgaggtcggtcacgagatccgcgacgtcccgcaacgccagacactgcagcgtccagtcgaacggctcctcccaggcgccgccgaagtaccggacgtgcagccccgcccgcatcggcgcgacggtgacatggttgaaatcggtctgccacagcggctccgcgggatcggcatggtcgcgcccgtactcggcgccctcgcgctcgcagaagtcgtgaatgcgccgctgcaggtcgagcaacagccgataagcggcggaatccagcggatgggacatggcgatgcagttccggtcggcgacgatcgcgacagtctatccgaccgtgcagccgtcgcgcacgacgctcatcgccgccgtgtgcccgtttcgtcgccgaccttcttcacgaccgtctcgcccgccttcaccggccggccgtcgtcgtggcgcagcgcgagcttgcggatcgcgcgccccgtctggcggtcgaccagcaccgaatgcggctcgcctcgcgcgaacaggttcgcctcgccccactgccgcagcatcacgatcaccgggaacagcccttcgcccttcctggtcagcacgtactcctgatacgcgctgccgtccgacgccggcacgacgtcgaacacgcccgcatccacgagcatcctgagccggtcggacaggatattgctcgcaacgccgaggctcgcgcggaaatcgccgaaccggcgcaccccgtcgaacgcatcgcgcacgatcagcaatgcccagcgatcgccgacgatatcggtcgcccgtgccaccgggcacggcgaatccgcaagacttttctgcctggccatatgcctctccgcaatcgtgccggccgccttcgcggcaacgccggccatccgtgcacggacgtctcgcccgccgcacaacaggttgcattttaaaaccacttttcctacactcacaccagtttcaatttgcaactactttgcgcgaggaaatccatggcgtcttcctgtcgttccggcaccgttgcatcgaacgcatccgcgcctgccgcgcatccggccgcggtcggcaccctgtccacggcgcgcgtcgcggcgctggccgtctgctgcgcggccagcgtcgcgaatgtctactacgcgcaaccgctgctcgattcgattgcgcgggatttcggcgtgtcgcaggcggccgtcggcggcgtcatcaccgcgacgcagctcggctgtgcgctcgcgctgctgttcgtcgtgcccctcggcgacctgctgaaccgcaagcgcctgatcgccgtgcagcttctgctgctgacggcggcctgcatcggcgtcgccgcatcgtcgacgcgcattgcgctgctggcagggatggtcgcggtcgggctgctcggcaccgcgatgacgcaagggctgatcgcctgctcggccgcgctcgcgggcgccggcgaacgcgggcgcgtggtgggtgccgcgcaaggcggtgtcgtggtcgggttgctggccgcacgctcgctggccggcgccgtcaccgacatcgcaggctggcgggccgtctatctggtatccggtgcgctcgcgatcgccatgctcgtcgtgctgtcgcgactgttgccggacgagaacgggccgcgcgagcgcatcggctacgcggcgctgctgcgatcgatggtgtcgctgctgcgcgatgaacgcgtgctgcgcgtgcgcggcgcgatcgcgctgctgatgttcgcggcattcagcatcttctggagcgcactggtgctgccgctgagcgcgccgccgcacgcgatgtcgcatacgcagatcggcgccttcggcctcgtcggcgcgctgggcgcggcggccgccgcccgcgcgggccggctcgcggatcgcgggcgcggcgaagcgacgaccggcgccgcgctcgcattgctcgcgtgctcgtggctgccgctcgcattcggcgattcgtcgattgcatggctggtcgtcggcatcgtgctgctcgacgtcggcgggcaggccgtccacgtcgtcaaccagagcatgatcctcggcgcgcggcccgatgcgcatgcgcgcctcgtcggctgctacatgctgttctattcggccggcagcgggctcggcgcgattgcatcgacgatgatgtatgcgcgcgccggatgggcgagcgtctgcgtgctcggcgcggtcgtgagcatggcggcgctcgtcgtctgggccgcgacgctcaggcgcgcgtgacgcgtgccggcgtcgcgcatcggatggggaaaccagccggccctgcgcaggcggccggcacgcgaaccggccgcgcatgcgcgccggttccgcttccgttcggcgcgcagatcgcgcgccacgggcgctcaacctgccgcccggatcgcctcttcgtacacgccggccacgcgccgcgcgatcaccgcgttgtcgaaatgatcgcgtgcatagcgcttgcacgcggcctcgtcgggcagcgtgatcgcgcccgacagcgcggcaccgagcccttccgcgatcgcgtccgcgccggtggacggcagcacgagatcgtcggacagcccggccaccgcctccggcagcccgccgaccggcgtcaccagcacgggcgtgccggacgcgagcgattcgacggtgatcagcccgaagccttcgagcgcgaccgtcggcacgacgctgaccgtcgccgcgcggtacagcgcggcgagatggttgtccggcacgaagccgagcagcttcacgttgtcctgcaggcctgccgcatcgatgcgctgctgcagttcctcgccgatcttgcccttgccggcgatcagcagcagcacgtccgggtgacggtgcttgaggaggccgatcgcgtcgatcaggtcctccagccccatgcgccgcacgagccggcgcacggccagcacgatcggccggtcctgcggcagttgcagcttgtgccgcgcctcggcgggcgtgagcggcgtgtcgaactgcgcggtatcgacgcaaccgggaatcacgcgcacacgcgacggatcgatcccgtagcggttcgtcaggatctggccgaacgcctgcgacagcacgatcagccgcgacgaacgcgtatagacggcctgctcgagataacgcttcgcgcgctggccgagcgacgcggcgccctcgacctggctttcgtcggcccacggcccctggaagtgcgacacctgcggaatcccgcgcgtgacgtcgaggcccgggaacgtgtacagcgcgaagtgcgacgagatcacgtccggccgctcgctgcggatctcctcgcgcagcgcgcgccgcgcggcgagcatgcggcgcgcgagcggctccgatgcggggccgaagccctggatcgcgccgcccgtgtcgtcggcgaccttctgcgagccggcgacgagcccgcgcacctcgacgcccgcgcccggcagcgcgccgacgagcgagtagtacatccggtcgaggccgcccgcgcgttcggggaaccagtgcatgccgatctgcaacgatttgatcggccgggaagagtgggacattacgattgctcctgcgtcactgcatgctcgacccgctcgaaggcggacggctgcgtgggttggccgatgcgccggtagagcgcgacatactgggcgcccatgtgcgcccagccgaaacgggtcatcaattcgcgggccgcgtcgcccatcgcgcggcacgtgtcgcgcgacgccgcgagcgagccgatcgcctgcgcgagcgcggccggatcgtccgggtcctccagcacgatcccgcattcgcgcgtgatgatttcggcgccgcccgccgtacgcgcggtgacgaccggcagcccggccgccatcgcctccagcagcgacaggctcatcgcttcgtagcgcgacgggaatacgtaggcgtcgaccgagcgcatcagcgtcggcatgtctttcacgaggccgaggaaatgcacgcgcgcatcgatgccgagcgcgcgcgcctcttccggatacgggctgccgggcagataaccggccaccgccaggtgcacattcgcgggcagcttcgtcagcgccttcagcaccgtgccgaggttcttgcgcggcgtgcgcaggtcgccgacgaacagcagcaggaacgcgtcgtccggcagcttgaacgccgcgcggtcggcctgcgcgccggcgaacgcgctgccgtcgacgccgttgtagatcacgctgatcttgcggctgtcgatgccgagcccggcgatctcgtcggccaccttctgcgacacggcggtaatcgcgcgcgaccgcttgtacgcccagcgctcgagcgtggtgttcacgcgcgtatagacgtactgataggccgaccacagccccttcgtcggcccgaacggatagtacggactcttgaaccagccgccgtgcacgaagtgcgcggtattcacgtcggccttgatccacgagatgaagccgttcacgtgcagcacgtcgtattcgctgcggtgcgcgcgcagccaggccgcgctcttcagcgcgaacacctgctgcttgacgagattcgacggccagaagccgccgaccttcaccggcacccagcgcacgcgcgggtcggccagcagctcgggcgcgacgtgcgacgcgaccagcgtgacctcgtagttctcggccagcgccgcgcgcgcgatttcgtaattgacgcggccctggccgtcgttatgtcgcacgacgtgcgtgacgatcgcgattctcaatggtcgcctcccgtgaatgcgcggcggccagcaggcgttgtgcctttgccagtgcgccgcggctagtatcgaaaaatggctgtgaacatcagcaggccgcccgtgccgatcagcgagttcgtgaacacgagcatcgcgaaggtcgacaggcacaggctcaggcatgcgccgacgaacttgtcattgcgcagcttgaatgccgcacgcagcgtgcggccgaacagcatcacgacgccggcgagatacagcagcgtgccgggccagccgagcacgaacggcacgttcatcacgccgctgtcgaagctgccgtacttgccgagctcgccgctgtcgctcgacagcttcgtggatgccccgtcgcgcccatccctcgccggcgacgtcggtgaacgccgtctgcgcgaaggtggcgtagaacttgttgcggtcgtcgtagctgcggtcgtccttcaggttcgtgatcgactgcaggcgcgcgccgagacggtcggccaccggcccgacggtcaggagcggcacgcacagcccgaccagcacgacgccgctgatcaggatccgcatccgcacgcggttgctcgactgcacgagctggatcgcgagcgcgatcacccagccgccccaggtcgagcgcacgagacacagcgcgaacgacacgaagccggccgcgcccgcgaaccagcggatcttctgcggcgcggcgaacacgaacaccagcgcgcccatgatcgcgaacgcgaacggcccggacgagttcatcgtgctgaacacgcgcacgccgtacggcaccggctcgccctgcgaacccatgtcggagccgatcatccacagcacgtcccactgcggcatcacgaagtactgcacgacgccgtacaggcccatcacgagcatgccccacatgaacgtggacagcagcacgtcgcggtattcgggatagtcgcgggcgttgaccatgatgtgaaaaccgatcagcaccgggtacacccagttcgcgaggtcgtaggtcgcggccatcacgccgctcgatacgatcccgacgaggtacgcgtacgcgagcccgaacagcatcagcaggatcgggattccgcgccgctgcgcgagcacgcggtaatgccggatcaaacccaggccggcgatcatcgtcaccgcgagcggcgcgacctggatcaggctcgtcggcgtgaacgcgcccttcgaccagtcggcgagacgccgcacttccgggctcaggaaccacacccaccacatgaagccgacgtagcgcgccggactcttgaaatacagccagatgccgaccgcgatggccagcaccggaaacgcgagcgtcagcaccttgccctggtgaatggcgatcagcgcggcggtgaaggaccacagcccggcctgcccgacccagtgcttccgctcgggcagccagttgcggcggcgcgacggcgcgcgttcggcggcaatcgtactcatcgatccgctctcaccgcgacgacgggcgcgaatccgcgagcggcatcgccaggcccgccgccgccggtgtccggcgccggcgcagcatgtcgcgcgtgatccgcacgtgctgctcggcgaacgcctgcgtggtcaggtcgcgctcgcgcaggcacgcggcggcggcccgcgcgcagcccagcgccgcgaccggatcggccgcgaagcgatcggcggcctggcgcatcgcctgcgcgtcgaaggccggcacataggcggccgtatcgtgcgggaaatagtcgctgagcccgccgacgtcggacacgatcatcggcttgccgaccgcggccgcctcgagcatcacggtgatgcccgacgcgtggaaattcggccgcagcggcacgacgatcacgtcggcccatgcgtacagttcgtgctgcttcgcgagccccgacgccgagccgatcttcacgttcggcgcatgccactcgcgcggcacgcggcgccgggtcgccagccgcacgtcgtagcgcgcgtcgccgccgaacgcagcgaggaacgtgcgccagtcgcggtcgcggtcgttgccgatcgccgcgatccgcagcggccggttcggttgccattgctgcggctcgacgatcgggaaatcctgcgtgttcagcccgtagtagacgaactcggcttcgcgaccgagataacggcggcacaggtcggcgttgtcgcgggccagcgtggtcagcgcgtcggcgcgcgcgatcagcttgcggtacagccagcggcgcgggccgccgaagctgccccacttgtcgaacagccacacgctctgcgcgagcagcagcggacgcttgccctgctcgccggccagcttcaggatcagcgacgccgcaaggtgctcctgctccgtgtgcgtccagatcacgtcggtgttcagcagcgcggcacggttgcgccatgcatgcacgacgtcgaagccgagcgccgccttcagcgcgcggcgcacgaggctggcgacgcggctctcgccgccgtcctgcgaataggtcagccggaattcgtcggattcggcgtggtgatagccgtacaggcagccgatgttctcgcctttccggtaggtacgcggatcggcgccgtggaacagatggacatggaccttggttgcagtcattcgagcccttctccgggttcggccgcgcggcgttgcgcgcgcgactcgttcaagacgtcaccggcggcatcgccgcacggtgggggcaaggttcgcgcggcgggcatcgcgcgcgccgcggcgcaccgcgcgccagtgctcgcggatccgctcgcgcttcgccgtatgcagcgacagcagcacgtgcgcgaggcccgggtagacgcgcgtaccgaccagcgtccaccaccaccacgcgatttcgcgccgcacgggcggcaggtgctcacgcaggatcaggtgcaggttgtatgcgccgttgctgatcgcattcagcgacgcggcatcgcgccggtcgtcgtcgaagcgttccgccggaaaatgatcgaccgcgatcgccgggtcgtagacgagcttccagccggcgcgctgcacgtgcatgctgaaacccatgtcgttgtgcacctgcgcaccggcgccgcgcagccgcgtgtcgaagcgcagccgctcgatcgcggcacggcggtagctcatgttcgcgcctttcagcatgtcgacttcgcgcatgccgccgacgccgaggtgatgattgccgacgatcttgccggacagcgtgagctggcccacgagctcgcgcgattcgtcgagcacgcggcccttctcgtgcacccagtcgcggccgccgaccgcgcccacgcgcgggtcggcctcgaacgccgactcgatgcgggcgagccagtcggggtgcggcgccgcgtcgtcgtcggtgatcgcgacgatgtcgccgttcgccgagtcgagccccttgttcagcgcggcgacctggcccggcacatcgaccggcacgatgcgcagcggcagcgcgccgccgaccgccggatcggcgagccgttcgtgcgtggcatcgtcctccgggcgcgcgacgacgatcacctcgtcgggcagccgctgctgccgctgcagcgccagcaggcagcgcgcgaggtcggcggggcgccgataggtcggaacgagcacggaaattttcatcgttggttctcctgtcggccgggcaggcggcacgcgcggcccgcccggttacgtgcgattcggatcaggcgctcaggtattcatgcacggccgcataaccgcggccgtagccgcgcgctttcggcggcacgccgttgaagatcccgccttccagatcgacgcccgcggtacgcaggcgcttgatcgcgtcggcgatctcgccttcggtatgcatgcccgagcgcagcacgaggaacgtcgagccggccatgcggccgatgatggtcgcgtcggtcaccgccagcaccggcggcgaatcgatcagcacgacgtcgtagcgcttgccgagcccttcgaggtattgcggcaggcgcgtcgacatcagcagctccgacgggttcggcgggcgcgtgccggccgagatgaacgacaggccctgcaccggtgtctcgcgcacggcgtcctcgagcgccgactggtcgctcagcagctcggacaggcccggctgcgaggtgaggccgaagtagcggtcgagcaggccgcggcgcatgtcggcgtcgatcagcagcacgcgcttgcccgaatgcgcgagcagcaccgcgaggttgaccgtcaggaagctcttgccgatgccgggcgtcgggcccgtcagcacgatcacgcggttcttcgcgtccatcatcgcgaactgcatcgcggtgcgcaggctgcgcaggctctcgacgctcagatccttcggacgcaggctcgcgaggatcggccgtgtgcggctgccgctcttctcggccgccgcgtcgagcttcacctgctcggcgctttgcggcaccagcccgtacagcggcaggttgaacgcgcgctcgatgcggtcggggtcctcgatgccctggaacaggttgcggcgcaggaacacgacgccggtgccgaggatcagcccgaggaacaccgcggccgacaggatcagcaccttcttcggcttgaccggggcgcccggacgcagcgcggagtcgacgaggtggatgttgccgcccgtgccggccttctgcaccgacagctcctgcacgcggttcagcagcagcacgtagatgtcctcggcgaccttcgcgtcgcgctgcagctggacggccttcacttcggtggccggcaggctgcggaagcggttgctgaacttgtccttctcgccctgcagctcggcgagctgctgcttcgcggcgatcaccatcgggtgcgaatcggtgaagcgctgcgcgagcgacgcgagttgcaggcgctgcgcggcgatctgctgctcgtactgcacgctgccctcgaggtagaccttcgcctcgtcgctcgcgttgatcgagcccgacgtgcgctggtactgcgtcagcgcggcttccgcccgttcgaggtcggccttcaggcgcggttcctcgcccttcaggaagtcgagcatcttggtcgcttcggcctgcttcgcgaccacgtgctggttcaggtacgactgcgcgagcgcgttcgcgatcgcggcggtctggtccgggtccttgccctcgagcgagatctgcacgacgcccgtctgcttgccctgctcggtcacctggatgccggcctggaagccgctgatcgcgtcgagatcgttgtagcggaccaccgtgaactgcgtgccggggcgcgcgacgagcttcgacacgagcagcgtcacgccgccgccctgcgtcgattcgccgacctggcccgacagcagccgcgtgccgttctggtcgacgagcgaataggtgccgttcgggccggccgtcagcgtcaacttcttgccttcgagcgcgggcacgacgctgatcgaatcgacgtcggcgacttcaccgccccatgcatacgattgcaggccgagccacggccgcgacggcgtgcccggcgtcgcgacacgcgcggcgaggctgccgatcagcggcagcgtcttcggcacgaccgagaaattcagcttgaactggtcgaccaccggcgcgacgacgccgcggctcttgatgatctcgatttccgcatcggtctgcgcctgctgcggaccggagttgatcgtcgcgccggtctgcgtctgcgtgagcgcctgcgacgtgttgtcgttgctctcgacccgcacgtgcacgtcggcctggtacaccggcttcgcgacgtagcagtagaggccggcgagcgcgacgaccgtcaccgcgatgccgagcagcagccagatgtcgtccatgatcacctggagcaactggccgaggacaacgtcctcttcctcggttttcacggacagatccgcgtaggagtgtttcgcttgcgtgttcaccattcgttcccgcttgagtggtgccggggcggaggtgccgccccggcgggctatcagcgcgtgatttgccgcatgtagaagatcgtctggatcgtcggcaacacctgctgcagcactcggttgaactgcaccgagctggccgtgctgacgtagaccacatcgagcggctgaagcgggaagcggctcgacagcatcagcgcatcgggctgcgtcatgtcgagacggaacacttcaggcttcgtcgggttgtcgcgcatgccgcgcatcacgtagatcttgcgcgggttcgcatcggtgtcgaggatgccgccgccggccgtcaacgcgtcggcgatggtcagcttgcccttgagcatcggcaccgtgaccggcgtcttgacctcgcccatgatgaacacgcggctgtcgctgcggtccggcacgttgatgatgtcgccctgctgcagcatcacgttctgccgcacttcgccgcggtcgagcacgccgttcgcgtcgagcgtgtagagcttgccgtcgcgcgtcaggcgcacgcgctgcagatcggcgtcggtggtcgagccgcccgaacgcgagatcgcgtcgaccagcgtcagcggcacgtcgctcatcgcgagcgggcccggggtcttcacctcgccggtcacctgcaccttctggctgcggaacgacagcacgcgcacgtcgagctgcggattcttcacgtaacgcgcgagtcgcgtggccagctcgtcacgggtctgcgcgatcgtcttgcccgccacgtggatgcggccgacgaacgggaagaagatcgtgccgtcggcggccaccgtctggccataaggatcggcctggcccggcagcgacgacgaatagggttgctgcagcgcgcccgcgatcgtctgcgtcgtgttgccgccgctcgagaacgactggccctgcggcgtcgtcagctccgggtggtcccagacggtgacgccgaggatgtcctgcggcccgatgcggtacacgtattgcgacggatcggtatagcgtccgggcggcagcggatggtcgacctgcgccttctgcagctggtccatcaccactttggcgtcgatgtaatgaaccggataggtctcggccgcttgctggcggccttcgtccttcaggttcgacgagtcgaggtagttgccgggcgcggttgcacaggctgacaggaaggtcgtcagcgcgacggcaagcgccaccgggcgcatcgggcgtttcagcatagtttctgtagccatccttgaaccagacgttcgatcagtgagtagctctcgcggtaatcggcctcggggccgccgtgcggatcggcaatctcggccccttcccacttgccgagcaggtggaccttgccgcgcgcgaacggatcgaccttttcgacggccgcgatctgtccgcgctcgctgacgagaatcaggtcggcgtcgcgcacgatccggcgcgacagccgccgcgagcggtgggtcgtcgcatcgacgccccgctcggcgagcagctgccgcatcaccggatcgatgccgtcgccgtcgttcgcatgcacgccggccgaatggaacgtcgggcgcgggccgccgcgcgacgcggcgtgcgacttgaacagcatttccgctgccgggctacggcagacgttcgcgtgacagacgatcaggatgttccggaacatggcgtctcgtaacgagtgacgggaaacgggttacgcgctcgcgggcgcggtgcccggtacacgcgcggcgacggcctggcgcgagcccggccggccgatcgggtggtattcgatgcccagctcggtcatcgtctccggctcgtacaggttgcggccgtcgaagatcaccggcgctttccacaggcggccgagcgcgatgaagtcggggctcttgaagatcttccattcggtgacgatcacgagcgcgtcggcatcgcgcgcggcctgcgcttcgtcgtcgacgaagctcagccgctcgagccagctcgggtgatcggcgagatcgagcgcgatcacgcggcgcgcttcctgctgcgcgaccgggtcgtacgcggcgatgcgcgccccgcgcgacagcagctcggcgatcagctcgcggctcggcgcttcgcgcatgtcgtcggtgttcggcttgaacgcgaggccccagatcgcgaacgtgcggccggtcaggtcctcgccgaagcgtgcgacgatcttctcggcgagcacgcgcttttgcgtggcgttgaccgacgacacggccttcaggatctgcagtgcctgcccgtgctcgtcggccgtgcggatcagcgcctcgacgtccttcgggaagcacgagccgccgtagccgcagccggcatacaggaagtgatagccgatgcgcggatcggagccgatcccgcggcgcacggcctcgatgtccgcgccgaagcggtcggcgaggttcgccagctcgttcatgaacgagatgcgggtcgcgagcatcgcgttcgccgcgtatttcgtgaactcggccgagcgcacgtccatgtacagcgtgcgttcgtggttgcggttgaacggcgcatagagcttcttcatcagctcgcgcgcgctcgcccggcacgtcgtcgtcgcagccgatcacgatgcggtccggccgcgtgaaatcgtctaccgccgcgccttccttcaggaattccggattcgacacgaccgagaacatctggtcgccgccgcgcttcgcgagctcttccgccaccgccgcgcgcacgcgctcggccgtgccgaccggcaccgtcgatttgtcgacgatcaccttgaagcccgtcatgtaacggccgatgttgcgcgccgccgcgagcacgtattgcaggtcggccgagccgtcctcgtcgggcggcgtgccgaccgcgatgaactgcacgtcgccgtgcgcgacggcggcctcgatatcggtcgagaagcgcaggcggcccgccgagcggttgcgcgcgatcacttccttgaggcccggctcgtggatcggcacgccgccgttgttcaggatgtcgatctttgcctggtcgacgtcgagacagaacacgtcgtgcccgatgtcggcgagacaggcgccggtgacaagacctacgtaaccgctgccgatgatagtcagattcatgatgtgtcggacctcttgaccaatgattcgaaattcgtaaaaccgcgatgcctgcgtggcgcggcctcggtactcagtacgcgttgctgccggtgaagcctttccagagcgtcagcacgacgatcttgatgtcgagccagaacgaccagttctgcatgtagtacagatcgagcttcacgcgccccatcatcttctcgatctggtcggtctcgccgcgaaagccgttgatctgcgcccagccggtgatgcccggcttgatccggtagcggaacatgtagcccttgacgagatccttgtagatgtcgtcgtgcgcgagcgcatgcgggcgcgggccgacgaccgacatctcgcccttcaatacgttgatgaactgcggcagctcgtcgaggctcgtgcgacgcaggaaccggccgaccggcgtcacgcgcgagtcgttcttggtcgcctgcgtgacctgcccggccacttcctggtgcaccttcatcgagcggaacttgtagatctcgaactcgtgcccgtcgatgcccttgcgtttctggcggaagaacaccggcccgcgcgacgtcagcttgatcaggccggcaatcagcaccatcaccggcgcgagcgcggtgagcgcggccagcgcgaacagccggtcgaacacgaacttcggcaggatccgcacgtcggtgatcggcgacgccgcgaggttgatcgccggcacgccgagcacctcgaccacttcctggttgaagaacgacagcgtgcgcacgtccgggatgaaacggatgttgacgaagtcgtggcggaacacggtcacgatctggtgaatccggcgttcctccgtgatcggcagcgtgagccacagctcgctgatcgcgcggctgcgcaccagccacaccagcgattcgaactgccgctcgatgcgcacgtcgtcgagcgcgacctcgcccggcgcttcgctttcgtcgtatacgcacaccgggttgaaaccggcttccggccgcgcccgcatctgcgcgatcagccgccgcgccgccggcgtcccgccgacgatcgcgaccgccttcaggttgtagccgccgcggcgcagctgccgcagcacgacgtgcacgcaggttttcgaacctgcgagcagcgccatcgtcacgagcgcccagtaacccagccacagccgcgacaggtcgcccgactggtggaagctgaagctcatcaggatgcccgcgagctcgaccacgagccatgcgaacgcaacccggcccaccagcccgacgagacgcttgccgcgccacgactggtaaatgccgatggccggaaagaacacgacgacgagcaggcagtcgaacagcaccgtcgtgcgctgcaggtcgttgagccagatgctgccgtcgtgcagtgcggcggcgatcagcgccccgctacgaccatcgcgatatcgatgactctcgccagcacgctcaacatgtctgcttcctctttgaacaggcgtttgccgaacagctccttgtgcgacccgtgccgcacattcgattcaaacgttgcatgacgctattgaagcggtaagaaaattccgcctcaagcgcacaagtatttcgaaaaataatcggaaattcttgctgcgtagtttttgaattaaatcggcagcttttcccgaaatgatcgcgaatcgggaatttttcggaagctttacggtttccgctcaccctttgcggacggtcaacaccagccgattcaccgatttatttttactttttatttgcaccggatgctggcgaggaaaattcttcccggtgaatgtccggcgaatatcaggcaatggacccggttttattgtcgatttacttcatgctacaacggcaggcactgacttcaaccgtggagagtgtcaacatgaatgctccggccgtggctgccgaaacgcgccattccccttccgccgcacccgccgtcggcacgcgcgtcgccgtgcaaccggtgattctcgccggcggctccggcacgcgcctgtggccgatgtcgcgcgagcgctttccgaaacagctgatcggcttgctcggcgaacattcgttgctgcagtcgaccgcgctgcgcctcgacggcctggcgggcgatcatccgctgaccgacgacgtgctgatcgtatgcggcgaggatcaccgcttcacgaccgccgaacagctgcgcctgacgggcaagtccgcatcgatcatgctcgagccgatcgcgcgcgacaccgcgcccgcgctgacgctcgccgcgctgcggctcgtcgccgacggcaacgacgcgatcatgaccgtgatgccggccgaccatgcggtggccgacctgccgcgctttcacgccgcggtcgcggccggcgtgcactgcgcgaagcaaggccggatcgcgacgatgggcatcgtgcccaagcacgcggaaaccggctacggctacatccgcgtcggcgcgccgctcggcgacgccgcgacgggcagcctcgacgtgcgccgcctcgatcgtttcgtcgagaaaccgcatctcgaactcgctcggcagtacgtcgcatcgggcgaatactggtggaacagcgggatcttcatcgtgcgcgcatcggtgtggctgaaggcgatcagccagctcgaacccgcgatctacgcggcctgcgaacaggccgtcgcccagggcaaggccgacggcgatttcttccgcgtcgatcgcgatgcattcgccgcgtcgccgtcgaactcgatcgactacgcggtgatggagccgctcgcgagcctgccgcaactgtgcgagagcgtcgtcgtgccgctcgacgcgggctggtcggacgtcggctcgtgggatgcgatctggcagatctcggagaaggacgaagccggcaacgtcggccgcggccacgtgctgctcgaagacgcggaatcgacgttcgcgcattcggaaagccggctcgtcgcctgcgtcggcacgcagaacctcgtcgtcgtcgaaacccccgacgccgtgctcgtcgcggacaagtcgcgcgtgcaggacgtgaagaaaatcgtcgggcgcatcaaggcgcaacgcggcgcggaagcgtccgatcaccgcaaggtgcatcgcccgtggggccactacgactcggtcgacatgggcgaacgcttccaggtgaaacgcatcgtcgtgaaaccgggtgcgcgactgtcgctgcagatgcaccaccaccgcgccgaacactggatcgtcgtgcgcggcaccgcgcgcatcacgcgcggcgacgaaacgttcctgctgtccgaaaacgaatcgacgtacatcccgctcggcgtgtcgcatcgcctcgagaacccgggcaagatgccgctcgagctgatcgaagtgcagtcgggcgcgtatctcggcgaggacgacatcgtccgcttcgacgatacctacggccgccagtaatacacgtgcgcccggggcgccgcttcgacggcggcgccccgggcgatgcaggcaggcatggaaagacgaggcttccgcgcgggcgtcgtggcacacgacggcccgcccgtttcaccggtgcggcgatcagcctacgcggtacacgtattcgcgacgctcctgctgcaccggatcgttgcggctttcggacagcgcgcccgtgtgacgctcggcgatgaagcgcttgatgtccgactccgcacgcgcgagcgcggacaggccggccagcacctcgccttgcggcgcgcgtgccggttcgtcgctcgcgccatggcgatcgatccactgacgtgcccagtcgagcgcgaactgctcggcttcctcggcatcggtgaagcgcgggccgatcaggcccgaacgctcgacgcgccgctcgtcctgcgagatctcggcccacgcgcgatacatcaggttctgcacgggctgcgcgatgccgcggatcgtatagccgcgatactcgtcgacttgcggttcggccgcggcgaagctcgccgacgacgcacgcgcatggcgcaactccaccgatcgcgcgcccggcaccacgaacgacgcgtcggacggccgcgcttcggcgtcgtcctgcatggacgactgcgacgcgccttcgccatcccaaacgtttgcgtgcgcgaccggcaattgccacgactcggggttttgccagaacacaccgcgcaagcgatcgttgtcgggcacgggctcggcacggcgtgcgggcacgaccggcaccggcggcggcgggatatacgcgaacgtgcgcccgctgaactgggtcagcacgtcgatcatctgcagcgtgccggacgccagccattcctcgtaacggcgacggcacgtcggcccggacggataacgaccgggcagcttcgaccaggcttcaccggtcgtcaggatccagagcaccgcgttggcgacgacgcgcggttcggcacgcggacgcccacgacggttcagccggatgggttcatcggcgatcagcgttgaaagacgaaaccactcttcatcggtaagctcatcgaagaacatagtagatctctccacgcagccaggccggggctgcgattggcggcgccatcgcgacacatcgcgtcgcggggcggccaggttgcacattatgcttatccggtgttgtgcatgccggtgcgacaccgcactttcacggtgccgccattcccggcaatggcgcacaaatcacggtctcactccaatgtgggaatttttgtgcacgaagcataccatccctagggtttatctcaatatgacaatgacttaatgttacgcactgaaacaacctgccaagggtgcgtaatgtatttacgcttgaattttttgcgggatctttatgcccgacgctgcaaaggcccgtctggcggggctctacagcgtatgaagaatgcccgtgaatgggcattttcgggtcgctccgacccctgccggcaacaatcccgcgcattgctgcccaacatcggtaaatcagggaaaaagcgtaacaagatattcacgaatcggtaaatcattcaaatttcgccgattttaattatctccgcgcacaatctttttattgtttctctgcgagtgatgaaagcccggtgacgtgcgatgcacgtctttcgctgcatgcaagttcgtgacgcctgttacatcttcgcggcggcaggagagcgaaacgcgccgcgtcgcgtgcggagatcgcgtttcgggtcggaacggaaaaatggaaaccggtgcgcgggacgcaccggacgtgcggcggacgtgcggcggatgcgtcagcgcagatcgccggccagcgatgcgctcacgtccgcgtccacgcgctgcgccggcatcgtgtaggccgggtgatcgcagccgatcgacagcgccgccccgcccttgagcgccgcgcgcatcggcgcgtcgagctcgaagcgcacgaagtgcacggccgacgtcttctcggcgttgtcgcgctcgagatcctcgtcggcgatcgcgtagatgcgcgcgtgcccgtcgacctgcaggtacacgcgatcctcgacaccgatcagccgcgcgagcgccgcgcgccgttcgacctcgtgctcgtactcgatctgcatcgtcgccttcaggttcgtgccgtcgggcacgagcggcagatacgcttccagctcccttcgatgccggcctggtcgaagatcttctcgatgtgtagcatctcctggatctgatagcggatcgtcgtctcgtcctcgaacaggaagcgcaggtggttgccaagggccaccgcgcggcggcgcttgtacgcaaccagccgcgcttgctcggccttgcggatctgcgcgtacgcttcgagcgtcagcagggagtcacgggtcaacgtcatgggatgtcctcgtggatcggccggcggcggctcagatgccgtatgcgcggcgcagcagcgtgagcggatgcgcgagcggcgcggacggcagcccgttgtcgtcgatgccctgcacgatgtgatggccggccagcgcgcagtccgacgacacgaaatccggctgcggctcggccatcgccttgaacacgggcccgccgatccgcatcgcgtccgcatgaaactcctttttcacgccgaacgtgcccgcgtggcccgagcagcgctcgacgacgttcacgcgcgtatcgggcacgagcgacagcgcgtcggccgtcttgcgaccgatgttctgcacgcgcgcatggcacggcacgtgatacgacacgatgccgaggcccgtcttgaaatcggtcttcagcaacccgtcgcgatgccgtgcgatcacgtattcgaacggatcccagaaggcgtcggccaccgcgcgcacggcggcgtcgccggggaacatcagcggcagctcgctcttgtacatcagcacgcagctcggaatcgcgccgatcaatgcataaccttcgcgcgcatagcgttcgagcacgggcaggttcacgtccttcttcgcggccacgccggcgagattgccctgctcgagcagcggcatcccgcagcaggcttctcgcgtgacgagctcgtaagggatgtcgttgtgcgcgaggatcgcgagcaggtcgtggccgatgcccggctcgttgaaattcacgtagcaggtcgcgtagatcgcgaccttgccgggcgtgcgttcgccgtcgcgcacgggcaggccgtccgacggtttcgccgcgcgccggaacttgcgcggcgcgaattcaggcagccacgcatggcgatcgacgccgagcgtcgcttcgagcgcatggcgcgcgggcggcgtacggttcaccgcgttcaccgcctgcgtgacgatcggaatgccggcaaagtgaccgagcgcgtcggtgttcgacagcaccttgtcgcgcaacgtcgcttcgccgcgcttgtagcgcgcggccttgccgcgcagcatcaggtgcggaaatcgacgttccatgcgtgcggcggcacgtatgggcatttcgtcatgtagcagaggtcgcacaggtagcactggtcgacgaccttgccgaacgccgccttcggcacttcctcgatatcgcccatcggcgtgtcgtcgaccaggtcgaacaacgtcggaaacgcgccgcacagagatacgcagcgccggcatccggcacagatgtcgaacacgcgcgtcatttccgcgtcgatcgcggcctggtcgtagaacgcgtcggactgccagtcgagcggatgccgggtcggggcttcgagactgccttccttgtggggcatggggcgctccagcgtggcgcgcatgcgcgccagcgccgcccgcgcgatgcgggcagcgatgaacgaacagccggccgcttgccggtcgcacggcctgccgtgcggcccgcggcggcccgtcagtcgacgagactgtccagcgccttcgtatagcggttcgcgtggctgcgttcggccttcgccagcgtctcgaaccagttcgcgatttcgtcgaagccctcgtcgcgcgccgtcttcgccatgcccggatacatgtccgtgtattcgtgcgtttcgccggcgatcgccgattcgagattctgtcgcgatgaaccgaacggcaagcccgttgccggatcgccgacggcttccaggtattcgagatggccgtgcgcatggccggtttcgccttcggcggtcgagcggaacagcgcggcgacgtcgttctggccttcgacgtcagccttcgaagcgaaatacagataacgccggttcgcctgcgattcgcccgcgaatgcggccttcaggttctcttcggttttgctgcccttgagttgagccatttgcgcctccgttcgagtcggcgcggccgcgtgcaaagccgggccgatcaggtatgtggggaacgatgcgtgcgctgcggcggcgcgcgcatcgtgctcttcaatctaggcgctcgcgttcgcatccccaataggctttttcaatccggacgatagtcggcgcgttgcgcggcggggtggtgcgcggggtggtgcgcggggtacgcgtgtgcggggtacggtgtgcggtgttcgcgttcgcgtgctgcgtgcgtactgcgtgcgtgccgcgcgcctcacgcgtcggtcgcgcgcctgagcagcaattcgcgttcgcgctcgttgcgcgtcagttccgccgcgcggcggaattcggccttcgcctcgtcggcgcggccgagcttcgcgagcagatcgccgcgcacgctcggcagccagtgatagcgcgcgagcgcgggatcgtcgcgcagcacgtcgacgagttcgagcgccgcggcgggcccgaacgccatcccgacggccaccgcgcgattcagttcgacgaccggcgacggcgcaacctcggcgagcgcgtcgtacagcgcgacgatctgcgcccagtccgtgtccgccgcctgccgcgcacgcgcatggcatgcggcgagcgcagcctgcaacgcatacggcccgcgcacgccgccgagcttcgccgcctgctccagcgccgcgaggccgcgccggatcaagagcggatcccagcggctgcgatcctggtcgagcagcaggacgggccggccctgcgcgtcggtgcgcgcgtgcatgcgcgacgcctgcagttccatcagcgcgacgagcccgagcacttcgctctcgtccggcgccagcccggccagcacgcggccgagccgcagcgcctcgtcgcacagcgccgggcgcgtccagtcgtcgcccgcggtcgccgcgtggccttcgttgaacacgagatagatcacttcgagcaccgacgcgagccgcgcgggccgcgcatcggcggccggcacctcgaacggcacgtgcgcggccgcgagcgtgcgcttggcgcgcacgatccgctgcgcgatcgtcggctcgggcgtcaggaacgcgcgcgcgatctcgcccgtcgtcaacccgccgagcagccgcagcgtcagcgcgacgcgcgcatcggtcgacagcaccgggtggcaggacgtgaagatcagccgcagcagatcgtcgccgatgtcgtcgtcgctcgcgtcggcgagcgcatccgcgatgtcgggcacgacatgcgcttcgagcgcgtccatctcgtggccgagctggtcgcgcttcgccgcgtggagcgactcctgccggacccggtcgagcgcgcggcgtttcacggccgtcatcagccacgcggccgggttgtcgggcacgccgtcgacgggccagtgctcgagcgccgcgacgagcgtgtcctgcgccagctcctcggccacgccgacgtcgcgcaccacgcgcgccgcgcgcgatgatcttgggcgcctcgatccgccagaccgcttcgatcgcacggtgagtcgcctcgagcgtcacgacgcctgcccctgggcggacgcatccagcggcatggccatcagctcccatgcatggccgtccggatcgtcgaacccatggccgtacatgttcggatactcgcgcggcgcctgcggcgcggacccgccggccgcgagcgccttcgcgacgatcgcgtcgacctcggcgcggctgtcgcacgacaggcacgtcagcgcctgcacctgcgtcgccggatcgacgatggtcttgccggtgaaggtctggaaaaacggccgcacgagcagcatcgcgaaaatcgtgtcgctgatcttgatgcaggcggcctgttcgttggtataggctggcacgacctcgaaaccgagtgcctggtagaacgtcttcgcgcgcggcaggtcggccacgggcaggttgatgaaaaccatcttgtgcatgacggatgctccggtgaacttggattcgggtggattcaggcctgggtgcggccgacgtggagatcgcggaaccgctcgaccgcgtcgctcggggtgaggtcgtcgagctcgaacagcggccgcacctcgatctcgcaatccatttcggcgccgaacggcgcggggaaccggcgcgtccattcgagcgcctcgtcgcgcgaacgcacctggatcagcgtatagccggcgatcagctccttcgtttcggcgaacgggccgtcgatcaccgtgcccttgccgcccgtgtagcgcacgcgccagccgcgcgcgctcggccgcagcccgttcgcgtcgagcagcacgccggccttggccagttcctcgtggtagacggtcatggcttcgaccagccggttgtccggcaacgcgtcggattcgctgacggcgttcgcccggatcatgatcatgaatcgcatcgtttactccttgtcatcggtggaaggcggcgcccgttcggcggcgccttatccggacgacggccggaagacgcccggatcgacacgttccgcgaccaatcagggtaaataccgagtcgcggcattcacaggaagcacgggccgaccgcgcgcacctcgaccgtgcaccattgcgcggccgggcactggcgcgcgatttcgatcgcttcctcgcgggtgtcgacgtcgacgaggaagaagccgccgaccatctccttcacctccgcgaacgggccgtcgagcaggcgcgtctcgccgtcgcgcacctgcacgcgcgtgccgcgctcggaacgctccagcgactcgacaccgcgcagcacgccgcgcgccttcagcgtctcggcgaaatcgaccatccgcgcgtacagcgcctggccttcgtcgagcgtgcgctcggcgcgctggtcggtcggctcgacaatcaacagcatgtaagacatggatttctcctgtgggaacggggcgcggcagcgtgtgctgcgcgatcgggatgcgccgccgatgcaaaagcgtaacagccgtcgtgcgccttgcatcgtcggccgatcggcacactggccggacggccaatttggccgcttcctgacattttgccgtcaagatgctttcccgaatcgtcggattttcttcctgtggaccgcctcatgtcacgcctgctttcgccgcctgccgttgcagcgttcatcgtcctcttcgccctcctcgccgggcccgccgcggccgcgccgccggtcagcgccggctgcggcggcgcaaccacgccgattgccgacctccgcggcgccggcggcccgtcgccgctggccgggcaaacgacctcgatcgaagcggtcgtcaccgcggcattcgccggtgccgacggcctgggcggcttcttcgtccagcaggccgacgcgcagcgacggcaccggccgggcgtcccggaaggcgtgttcgtgtacgcaccgaacgcgcgtgcaaaggccggcgatctcgtgcatctcacgggccgcgtcgacgagcgatacggccggacgcaattcacgctgtcgggcggcatgaccgtctgcgcacgcgggcagaccgtcaccccggcgacgctcacgctgccggtcgcaacgctatccgtgctggccgcgcatgaaggcatgcgcgtgcgcctgccgcaaacgctgacggtcagcgatacccacgcactcggccgctacggcagcgtcgtcctcagccacggccggctgcgcatcccgacccacatcgcaccgccggccgaggccgccgcgctcgcggcagccaacgcacgcaaccgcatcgtgctcgacgacggctcgacccgccgcgatcccgcaaccgtgcgctatccgcccccgcgctcagcgccgccaacacgctgcgcgcgggctacacggtgcgcggcgtcgagggtgtgctcgaactgcgctacggcgcatggcggctgcaaccggtggccggcgcggcgccggtcttcgatgccgcctcgaacccgcgtaccgatgcgccggcccgtcatcccgatgccgacgcgcgcatcgtgtcgttcaacgtattcaactatttcaatggtgacgggcacggcggcggattcgatgccctggccggccgaggagcgaaaacgcccgccgcgttcgcgcggcaggaggcgaagatcgttgcggcattgcgcgcgctgcgtgccgatgtgatcgggttgatggaaatcgcgaacaacggccacggcgacgcgagcgccgtgcggcgtctcgccgcgcggcttggcgaaggctggcgcgcggtcgatcccggcactgcacggctcggccgcgatgcaatcgcggtcgcgctgctgtacgacagccgcacgatcgagccggtcggccgcgccgcgaccgtctcgctcggcggccggcatcgcccgccgctcgcgcagacattccggcgcatcggcggcacgcgcgcgtggacggtcgcggtcaatcacctgaaatcgaagaactgcccggacgcgaccggcgccgatctcgaccggtcggacggccagggctgctggaacgcggcgcgcacgcgggccgccgtgcgcatcgccgactggctcgccggatcgccgaccggtgccgcggccgatggcgtactgctggtcggcgacctgaacagctacgcgaaggaagatccggttcgcgcgctcgagtcgcgcggttacgcgaacctggtggcgcgcttcgtcggcgatgctgcgtacagctacgtatttcgcggcgaggccggcagcctcgatcacgcgctcgcgacgccggccctgaccacgcgcgtcaaagccgtgcacgtctggcacatcaacgccgatgagccgtttgcactgcaacccgtgcccgattacaaaacggccgcacttcggtcgtcctattacgcacccgacgcatatcgatcgtcggaccatgatcccgtcgtcgtcgacctcgcactggacaacggcccgcgaatgccggtcgcaggcacaaaccctgctcgcccgtacggcgtcgattagtgcatttgcatcagcccatcgcctgcaatggcactatttacctggcaccccgggcgacgccatatttaccgggcattcacttcgtatcgcttcttgttgcacgcgtttcgcccatttgagaattttttcaatcttcgcgcggccccgcgtggcggggcttccaggcaattccgccaacgaattgaaaatttgtctcgaaactcaaccgggccaagcgaatcacattagttgctgggattcgtcttatcttcaaattggccttgaatcgaaggaggataaacaccatggcgctcactgactcgatcgaacacaagctggaccgcggcctgtccgacattcgtcgcacgggccggcgcgtgggacgcacgacgcgctcggccgcccgcgacctgcatgccgacgtcaccgacgatctgcgcgggctggtcgatgaactcgaggatctgctgaaaaacgacggcgacggcgatatcgccgcgctgcgcaagcgcgtgcaatccaggctcgatgaagcacgcggcgcgctcgaccatgcgtcgggcagcgcagccgcccggctgcgcgattccgccgaacgcgtgtcgcaggtcgtgcaagacaacccgtggcaaaccgccggcgtcgttgccggcctcgcgttcgttgcgggcctgctccttgcccgccgttgaacggagccggccgacccgccgcccgccccgtccgtcatcaatcagacaaagaaggagaaacgccatgcagaagacctttgccatgaaagccgccgccgccgtcctgctcggcagcctcgcgctcgccggctgcacgaccaccccggacaagccggaaggcgccgcggccagcgcgtcgaagcgccagtcgatcgacgccagcgtcaacgcgacgctctcgcgtctctattcgacggtgccgggctcgcgtgaactcgtcgcgaaatcgcgcggcgtgctcgtgttcccgagcgtgctgcaggccggcttcatcgtcggcggccagtccggcaacggcgcgctgcgcgtcggcggcagcacggtcggctactacaacacgtcgtcgctgtcggtcggcctgcaggccggcgcgcagtcgaaggcgatcgtgttcctgttcatgacgcaggatgcgctcgactcgttccgcaagtccgaaggctggtcggccggcgccgacgcgtcggtcgcggtcgtgaaggttggcgcgaacggcgcggtcgactccaacacggccaccgcaccggtcgaggtgctgatcctgaccaacgccggcctgatgggcgacctgtcggtgaacggcacgaaggtcacgaagctcaacatctgacgatgcggcacgcggcgttgcgccgcgtttgcttcccggcagcgccgcggccccggccgcggcgttttcgcatgtgccgcgcgtagccgctatgatggcggcacctttgcgggcatactccggttcgggccgcccggcggatggccgcccgcagcgcgttgcgccgggaacccgtgacgatcgcgaaccgatcgcgcacggggcaacgagattcaatcaaaccacgcatcaatctgcgcgaatgtcatccatggatagcggacacgaccaccaaaaattcttctatttcctgctggccgcggtcaccgtcggactctgctggattctcacgccgttctccggcgccgtgttctggggcaccatactcgcgatcctcttccagcccgtgcagcggtggctcgccgcacgcttcggcaagcggcgcaacctggccgcgctcgtgacgctgtcgctgatcgtgctgatcgtgatcctgccgctcgtgttcgtcgccgcgacgctcgtgcaggaaatcgcgtacgtgtaccaggaaatcaagaccgcgcagccgaactattcgcagtacttccaggacatcatccacgcgctgcctacgtcgatccagcacctgctgcagaaatacggcctgagcaacctcccgggcatccagaagaagctgaccgatggcgccgcgcagatcagccagctcgcggcaacccaggcgctcagcatcggccagaacaccttccagttcgtcgtgagcttcggcgtgatgctgtacatggtgttcttcctgctgcgcgacggcggcgagatcggccgccgcgtgcgccgcgcgctgccgctcgacgacgagcacaagaacctgctgctggccaagttcacgacggtcgtgcgcgcgacggtgaagggcaacatcgcggtcgcgctcgtgcagggcgcgctcggcggcctgatcttctggatcctcgagatcgaaggcgtcgtgctgtgggggcgctgatggcgttcctgtcgctgctgcccgcgatcggcgcgagcctcgtatgggtgccggccgcactctacttcctgatgatcggcgcggtgtggaaatgcgcgatcctcgtcgcgttctgcgtgggcgtgatcggcctcgtcgacaacctgctgcgcccgatcctcgtcggcaaggacacgaagatgcccgactgggtcgtgctgatctcgacgctcggcgggatggcgctgttcggcatcaccggcttcgtgatcgggccgctcgtcgccgcgctgttcatggcgagctgggacatctacgcacgcgccgaacagggcgaatgacgcaacgcgtggccgcgtgccacgcccctgccgacacgcgccgtcacggatgacgaatgcggatcacgacgggcgccacggcgcccgtcgcgtcatccgccgcgagcgtcatcacgccgccatacggacccacgcgatacgggcggcccgataccagcggcacgcttcgatcgtcgcgcgcatcgcgccacgttgcgcgcaccccgacgcggtatccggtacgaacggcgcgccgtcgggcccgaccagcgccacatgagccccggcaagcgccggccatgtgcatcgaaccgcagtgtggccaccgccccgccgctctccacctcgcgtcccggaaccaccacgcccgaccgcgcgtcgagcgtcacgtcgtagagatcgacgagcgcgccggcaaaccgcacgataccgcccggcgcggcatgcccggccgccattgcactcgacatcgcaagcgcaacaccaagcccgatcgccatcctcggcacagtaccggcgcgccgcaccgttcgattgcgcgtcgccgccgatgccgcccgcttcgcgtcgtttcgcatgttcacgctcctcttccgtgtaaccagaaaaaggcgacgtgacgcgtcggtcacgccgccatctgctggcaatcactttaggagacacgccccgacaatatatgagacaagtccgaaacttaggcccggttgatcgaacgcatcacgttcgacacgccctcgcggcagcgtgcgaacgacatcgcacgccgtgccgcgggccggtcacgcgtccggatcgacgcgcagcacgagcttgccgcgatggtcgccgtcgaacaggcgattcagcacgtcgggcgcgttttcgagaccgtcggcaaccgtctcctcggccttgagccggccgtcgcgcagccagcccgagagcgtctgcacggcctcgcggctcttgcgatagtcgaggatcaggaagccgcgcatcgtcagccgcttcgagatcagcacgccgacgtcgtccgccgcgcggccgctgttgtagttcgagatcacgccgcacagcgcgacgcgcccgccgatcaccatccgcgacagtaccgcgcgcatcacctcgccgccgacgttctcgaaattcacgtgcacgccgtccggcgtcgcggccttcagctgctgacggaaatcgtcggccttgtagtcgacggccgcatcgaagccgagcgtctcggtcaggtagcggcacttgtccgcgccgccggcgataccgaccacgcgcgcgccgtggatcttgccgatctggccggcgatcgagccgaccgaaccggctgccgccgatacgacgagcgtctcgcccggctgcaccggcgcgatgtcggtcagcccgtaatacgcggtcagtccgctcatcccgcacgcgccgagcagcgtcggcagcggcaggcccgactgcgcgggcagcttcacgagctgcgcggcctggtcggccggcacgaccgcgtagtcctgccagccgacgagcccctgcacgagatcgccttccgcgaaacccgcgttgcgcgacgccaccacgcgcccgatgccgagcgcgcgcatcacctcgccgatcgccaccggcggcaggtactgcggcacgtcgctcatccacacgcggttggtcgggtccatcgacaggtacagcacgcgcacgagcacctcgccgtccgcgagcgccggcacgggcgcttcgacgagcgagaaatgttcacggccgacccgcccttccgggcgcgtcttcagcagcagttggcggttcacgggtgtggacacgatgtactcctccggtcgttgttgttcgggatgcgcgtcagaccgcgcacatgccgccgtcgatcacgagttcggcggccgtcacgaagcggctctcgtcggacgcaagataaacggccgcgtgcgcgacgtcgtccggctcgccgagccggcgcagtggaatgccgcgcgcgagcttgcgcgtcgcgtcgcgttcgccgagcgtctggaacagcggctcgacgatgcccgtgcggatgaacgccgggtgaatcgagttgcagcgcacgtcgagctcgcggcgtgcgcagtcgatcgcgaccgacttcgtgagcgacgcgacggccgccttcgacgcgttgtacgcggtgaaatccggctcgaccttgaacgcggccaccgacgagatgttgatgatcgatgcgggatggctttcggccagatacgacagcgcatgcttgcagccgagcacgatgctctcgacgttgatcgccatcacgcgccgccattcgttcagctcgatttgcgcgggcgagccgatcgagccgacgcccgcgttgttgacgagcaccgacagcccgcccatcgcgtcgaccgcctgcgcgagcagcgcctgccagcgcgcctcgtcgcgcacgtcctgcgtcgcggcgaacgcgaccggcgtcgcatggcctgcgttgagttcctgcgcgaacgcgtcgagcaccgccgcgtcggcgatgtcggtcacgaacacgcgcgcgccctgctcgaccatccggcgcgcgatcgcgcggccgaggccgcccgcggcgcccgtgatgtatgcgcacttgccggcaaggcgcgaagaaacgactgtcatgtgaccatctcctatcgtgaatcgtcgtcgcggaacgctgccgcgacggatgttccgtgccggttcccgccagcgcgggccggttgaccgtgcgtcgccatcacgaggcgccgcacggtttccgcgagtatatcgagatgagcgtgacgcgcgccggacacgtcgggcagcctgccccggttgaacgacagccagcgtacgcgaatgccgccgatcgatgaaatgaatattcgttatgcccggtcataggctcgactcatgaccttcgcgtgacgtcacgcacgcgcaagccggcgcggccggtcacgcagaccggccggttcgtcgaatcgtgtcatggcgagggtcgagttccgcgcaggcgaggaatcgcacgaccacggccgaatgcggaaggaaatcggcaggaaagcagcgccggcgcaccgcggccggcgaccgtcagaaaccgtcgcccgacggcgcgcgcacgaacgcgcagagttgcggcgaatgcgtgtcgatcatctgctggaacggcgcgcggtgcccgtacgcgatgccggacacgagcagcaggcaaacggccgcgacacgcggcgagaatgcgcgctgccgcacaccgtcgtagccgcgcaggaacaccagcgcgaccagcgcgccgagcatccagccgacgatcacttcaggaacggtatgcgaatgatcgaacacgcgcgcgacggccgtgaccgcgccgatggccagcccggccgcgatgccgggcgccttgcccgtccggaacgcctgccacagcatcgacagcgcgacggtccacaccgacgtcgacagcatcgtgtggccgctgatcacgcggaaatcgaattgcggaagctcgatgccgcacccggcatacaggatcttcgtggcgccgacgacgcccatgccggcggcgagcagcacgccccagcgggcggcgaggcgccagtcggtcagcgcgagccaggccgcgcaggtcagcgcgatcggcaaggtcagcgcggcatcgccgatgttgctgatttcactccacataacggacttcggacgacgatcgaaaggccgcagtttaccgcatgcgcgccgcgcgactgtgtcagcctgtgacaggctgtatcagcccgcgacaccggtaatcagcagcaggttcgtgccggtgatgacgacgaacagcgcccacgcggcggcctgcatcccgcgcccgatcgtgtgctcgcccatcgtgttgcgatcgctgaccgagcggatcagcggccacatcgcaaacggcagctgcaggctcagcagcacctggctccataccagcagtttcccgaccgagccgtcgccgagccacagcacgccgatcagcgcgggcacgagcgcgagcccgcgcgtgatcagccggcgctggtagcacggaatcttcgtatgcaggaagccgtccatgatcacctggccggcgatcgtgccggtgagcgtcgaactctgccccgacgcgagcagcgcgatgccgaacagcagcgcggccgcgccgcccgcgatcggcgtaatcaggttgtaggcctgctcgatgtcggtcacgttgtgctggcccgtcgcatggaacgccgcgcccgcgacgacgaggatcgccgcgttgacgagcatcgcgacgaacagcgacacgcaggtatcgatgcgcaccagcgcgagcgtgtcgcggatcaccccgcgcgccccaccgaccacccgccgcgtctgcacgaccgacgaatgcaggtacaggttgtgcggcatgatcgtcgcgccgacgatgccgagcgcgagcacgatcgcgtccttgcggtcgtgccccggatcgcccggcaccagcccgccggccaccgcgtgccagtcgggcggcgtgatcgcgacctgcgcgacgaagcagaacgccatcgtcgcgatcagcgcgagcacgatcgcctcgatctgccggaaccccttgccctgcaggccgagcacgatcaccgtgtcgagcgcggtcagcacgatccccacgcgagcggcacgccgagcagcagcttgaacgcgagcgcgcagccgaggacttccgcgatgtcgcacgcgatgatcgacacttcggcggtcacccactgcacgatgcggccgaaccgcccgtagcggtcgtagctggcctgcgcgagatccctgcccgccacgaggccgagccgcgccgcgagcatctgcaggaagatcgccgcgaggctcgagaacgcgacgacccacagcagcgaatagccgaactgcgagccggcctggatgtcggtcgcccagttgccgggatccatgtagccgatcgcgaccagcaggccggggccgaagaagcgtttgagcttctgccagcgcggcgcgccggcatcgatcgtgatgctgccctttacttccgacgggcagaaaggggcggtggcagtggtggggaggaaggacatggaaaccgggaatcgaaatcgcgacaggacgattctacgggtatccgtccggtttttccgcgcggcggcgcacggggcgcattgcccccggcgccgtcgcaggcctcccgtgcgcatcggccggcggggcgccgcgagtgaggatcctttcacgctcggagacgcgatattcggtcggcgacatcagcatgcgctggcggaacagcttcgcgagccgctcgccgctgccgaacccggtacggcgcgcgaccttgtcggccggcagcgtcgtgtggaccagcatgtggcaggcgcgctcgagccgcacgtgctggacgaattcggtcggcgtcacgccgatctccttcttgaagcgccgcagaaattgcgctcgctcatcgcggcggcctgcgcggcgttcgcgatcgagatgcggttcacgctctgcgcgcgcagccgctgcgccgacatccggatcgacgggctcgcgctcagctcgcgaaaggcccacatcgactgcgcatagcgctgctcgaccggccgcagcatgttgctggcgatctcctgcgcggcgccgtcgccgagatcgacgcggaacatgtcgagcaccgcggcgaacacgtcggcttcccggcctgcaactcgaccgtcgtggcgacccggcggccggcccggcccggccgcccttcgatcgccgccgacggtcgctgcatggccgcgagcgtcggcaggtccatcgcgtcgacgatccagcgcgcatgacggcggatgtcggtgaggcggcgctgcaatgcgtcgtcccagttgacggccgcacggtcgccgtgaagatgaaagaacgcgagcgcgcggcgaccgtgctcgtcgccgagcggatcggccgcgatgctcacgccggacgacgactgcaacagcccccgctttcggatacgtacttcaactgatagtcggcactgtgtgcgtgcaggcgattcgccagattgaaagcctcgccgatacgcgcggcctgggccaacgaaaaccccgtactcaaatagataacgacccacctctgatctgctgcattcactggccaagccccgacttgtttcgacttcttctaataccgtcgaactgtcaggcttatatttggtttgaatgcgtgcgacaggacggctatcccgaaatatgaagcgacggcatcttagccgaacgggtcgcggctttggcgcgaaatggccgacgtggacagcatgatggcggattactacaggctgccaggggttgctggcgggccggtgcggaattgcacgggccgatatcgccaattgttacgattgtgtgcatcgaaatccgtgcattttcacgacgacgaattgcgtcgggtatccggataaatgcacagtcgaatatcggcgcaaacgatatccccatgtattcaataccgtcgatcgccacgcaggaaagcccgcgtatccgttgcctgcgcatcctttagaatcgctccaccattcaccacgccacccgcgccccgtgcccgccgaccaccgtctcgacctgaacctgtttcgcgtgctcgacgccgtctacgtgcatggcggcatcggcgcggccgcccgcgcgctgcatctcacgcagccggccgtcacgcacgcgctcaaccggctgcgcgcgcatttcgacgatccgctgttcgtgcgccagggcaaccgtgttgtcgcaaccgaacgcacgcgctcgatcatcacggacgtgcaactgcacctgaagggcctgcaaggcaccgcgcgcgcgccgtcggcattcgatcccgcgacgctcgacctgagcatcgcggtgggcattcgcgacgtgctcgaatcgatcgcgctgccgcggatcgtcgcggcgttcgccgacgaagcgccgggcctgcggctcgtgagccgtcgcatcgcggtagccgggatcgaacgcgaactcgcatcgggcaatctcgatctcgccgtcgatcgccgcgtgccgaccggcccgcgcatcgccaccgaacacctgctcgacgattcgctcgtcgtcgcactgcgccgcgatcatccgcttgcgcgcgagccgttgcggcgcggcgactatttcgcggcgcagcatgtcgcggtgtcgtcgctcggcgagccgcaatcgctcgacgtgctgctcggcaacgacggccgctttcgcgatatccggctcacctgtcagcactatttcgccgcgtgccagatcgccgcgaccggcaacctgctggtcacgctgccgcacacctatgcgttgcggatggccgcgatgctgccgatcgtcgtgcggccgctgccgttgcggctcaagccgttcccgctcctcgcgtactggcacgaatcgcgcgacgccgatcgcgcgcaccagtgggtacgcgagcgcatcgccgcgctcgtgcgcagcagtgccggcggcgcggacgcgtagccgcatcgcgcgcgccgtcgccgtcgccattgccatcggagcggtatgctgacggctgcgtgccgccgcgcggcgcccactttccactttccgactccctttttccttttcccgctgaccggagacttgccatgtcgctcatccacgccgccgccgtcctcgacgccgatgcgcccgattacgtcgtccagcttcaggccggcacccacgcgctgaccggcgacgaagccccacgcgagggcggccaggatcgcgggccggcgccctatgaattcgtgctggccggccttgcgcaatgcacggccgcgacgctgcgcatgtacatgcagcgcaaggcgtggccggccgcgcgtatcgacgtgcgcaccgagttgcatgccgatcgcgaaggcacgcagtacgtgcgccgtgtcgtgacgctcgacggcccgctcgacgatgcgcaacgccagcgcctcgccgaaatctgcgagaagacgccggtcacgcagttcatcaagcgcggcacgcggatcgacacgacgttgaactgatacgcaacgcacacgacacacgatcaccgcgcaaatcgccgcgcaaaggaaacgggggccgcgcacgtgcgcggcccccgttcgtcgataccgtcaggcgcttacagtccgagcgcggacaggtcgagcttgccgtccttcatcggcgggcaccagaaatacgcgcccgtcagcggccgcgtgaagcggaacaggccgtcgacgatcccgtcttccgcgccgctcatccggcgcatctgcacgtcgaacgcgcggaacgagcagccgaacgccacgaagtagaggcccgcgcggcgcgcgtccgaccacggcgacgaacggcgcagcatgaacgcttcgggctcgaagctttcctgcgcggtgcgcttcacgtgcgcgaactcgggtgcgtcgtcgagttcttcgttgtccgagcggcggcgcccgatgatgttgtccatgtcgcccgacggaatgcgctccatctgctcgaagtcgtgcagccattgctggaccgcgacgaagctcgcaccgtcgagccctgcgccctgcccggtcacgatcgccgcggccacggcttcgtcgccttcggggttctcggtgccgtcctcgtagccggacaggtcgcgatcgttcgaatagcggaaaccgtcgaccgcatcctgcaacgcgaacgccggcgccagcgcgcgttcgatcgcccgcgcgcgcagcacgatctcgccgcgatcgccgccgcgcagccagacccacacgtcggccggcgtcgccggcagcgtgcggtccttcaccgcgaacgccgggaatccggtcaggcccggcaccgggtgcccgagtgcgccgccagcgcatgtccgaacccgacgaccgtgtcgcgtccgtcgacgatctcgcgcagcgcggccagcgccgccgccacattgccgtcgttcgacatcgtgaaagtgaggtatcgggccgccgtatcgatcggggtcaggatgccttgctgaacgtcgctcatcgtttcctcaggaatgtatcgtggtgaatctgcgagggccgcggcgcggtgcgccgcaaacgtcgaagtgtaatcgatgcgtgtgccggcccctgcgctgccgcactgtggaaggcccgccaaagaagggccgaagccctgaatactaaccgtatcgacgctgcaacgccgcattcgtcagacgttgcggggcgcgcggcactgctgatagaatctttccacgtcttttcggcgtcctttcaaccgttcacttcagggaggtgcagatgttccgaatgccagcaaccttcccgaacgtggtcccacggcgcagctgatccagcccgccgtccgcgccggctcccgagttttccgctaacccgtcagccgcgccgtttcccgacagcccgtttcgtttcgccgcacggtttccgcgcggcccggctgttgcgttttcgatgttcgcccaaccggaaagccccgtcgcgcgatgcgccgggcaacgataaatgaccagaaaaaccacccatctgggcggccaggcattccaggccgtcttcggcttcaccttccgttactggcgcaagcagccggcccgcaccgccacggtcgcgagcctcgcgctgctcgccgcgctcgccgacgtgctcacgccgctgttcgccggccgcctcgtcgacgcgctgtcgaccggcctgaccgaccgcgccgccgcgtggcatgcggccctcgtcgcgttcggcacactcgccgcgctcggcctcggcgcgacggtgctgcgacaaggcgtctacctgaacatcatcacgctcacgctgaagatgatgagcgagatcgcggccgcgtcgttccatcgcgtgcagcgcttctcgaccgactggcacgcgaacagcttcgcgggctcgaccgtgcgcaagatcacgcgcggcatctgggcgctcgacctgctgaacgacaccgtgctgatcgcgctgttgccgtcggtcacgatgctcgtcggcgcgaccgtgctgctcggcacgcactggcccgtgatggggctcgtcgtcggcgcgggttcgctgctgtacatcacggtgacggttgcggtgtcgctcggcatcgtcgcgccggccgcccggctcggcaacctgtgggatacgcgcatgggcggcgcgctcgccgatgccgtgagctgcaacgcggtcgtgaaggcgttcggcgcggaaacgcgcgaggaagcgcggctcgcccgcgtgatcggcaaatggcggcaacgcacgcgccgcacgtgggtgcgcggcacgctcaacggcgggttgcagggcgcgatgctcgtcgcgatgcaggccgcgatgatcggcgtcgcgctgcggctgtgggcgaacgacgaggcgagcgtcggcgacatcgcgttcgcgctgacgatgttcttcatgctgcagggctacctgcgcgacgtcggcatgcacatccgcaacctgcagcgctcggtgaacgacatggaagaactcgtcgcgctcgaacgccagccgctcggcatcgacgatcgtcccggcgcgccggccatccggatcgggcaaggcgagatccgcttcgagcacgtgacgttccgctacggcaaccatccggtgccgctgtacgacgatttctcgatgcgcatcgcgccgggcgagcgggtgggcctcgtcggccactcggggtcgggcaagacgacgttcatcaagctgatccagcgcctgtacgacgtgtcgggcggccgcatcacgatcgacggccaggacatcgcgcaggtccggcaggattcgctgcgcagccagatcgcgatcgtccagcaggagcccgtgctgttccaccgcacgctcgccgagaacatcgcgtatgcacgccccgacgcgagccgggccgacatcgagcgcgccgcgcggctggccagcgcgcacgacttcatcgccgcgctgccggacggctatgacacgctggtcggcgaacgcgggatcaagctgtcgggcggcgaacgccagcgggtcgcgatcgcgcgcgcgttcctcgccgatgcgccgatcctgatcctcgacgaagccacgtcgagcctcgacagcgaaagcgagctgctgatccagcaggcgatggagcggctgatggtcggtcgcacgacgctggtggtcgcgcaccggctgtcgaccgtgcgcgcactcgaccggctgctggtgctcgaccgcggcaaggtgatcgaggaaggcagccacgacgcgctgatccgcatcgacggcggcatctatcgccggctgttcgagcggcaggcgctggaactcgcgaaggggctcgccgattcgccgcggcgcacggcggacaatcatgccgggccgctcggcgagcccaccgaggcgtgacgcaagaagggcgcgacgcgcgccggtggtgcggtcatcaccgccggcgcgcgtcgacaaatggatccggatcgaggccgtgccaggtgcacggcctttttcggccgcgaattccgcccgccctccggaagccgcgcgccgtcaggccgcctcttccggtatcccttatcatgtgggccagcaagtttgcgacaagggatcgaccatgtttacaggaattgtccagggcgttgccaccatcaagaccatcgccgaccacggggaactgagaaccttcagcatcgaattcccggaacggtttaccgacgacatcgagatcggcgccagcgtctcggtcgacggcgtctgcctgacggtgacgaccatccattcgccggaactgatcgacttcgacgtgatgctgccgagcctgaaaatcaccacgctggccgacctcacgacaggcgcgcggatcaacgtggagcgggccgcgaaggacggcgcggagatcggcgggcatccgctgtccggccatgtcgacttcaccgggaccatccgacacatcgcatcgtccgagcataaccggatggtgcgcatcggcgtgccggacgcattcaagcggtacgtgttcgcgaagggctatatcgcgatcaacggctgcagcctgacggtgtccgacgtcaaccgcgacgaaggctggttcgatgtctggctgattcccgaaacgcgtcgcgcgacgaccttcgatgcgaagggcgtcaacgacacggtcaacatcgagatcgagcgcagcacgcaggtggtcgtggacacgatccgggaatcggtcaaggaaacgctcggcgaactgaacggtgtcgtcacggcgttgctggccgaaaaaggcatcgatatcgaggaattgctggcgcgccatgtcgcgcgcctgccgaagcagtaacggttgccggcgcgctaggtaatccgctggatcaccgagtaccggccgccgtcgcaaaacacctcgacccacggctccgcttcctcgaacgtccagaggacgagatcgagatcgagatcgaccggttcgtcgtcgtcgggccagcgcatgttccacccgcccgcgacggcgaccggcccgcccgtgtagagcgggcattgcgccatccactcacgctcgtagtcgtgtgccgcgatgcccctgaagttgctgttgaatccccagtcgcgttgccagccgtgcgcgtcgagataggcgtcgatcgcggctgagccgaagcggaacaccgcttcgaccggcgggagcgacgtagcgtcggatcggcacagcgggcggtccgaccgggcgggttgcgcggcggtttccacgcggcccgatgtcccgccctcgtcgagatacacgttcagccaagtgccgtcccgctcgaccgagacgcacggcgcgcctgcttcaacgccatgccagtagccggtgacgggttcccgccactcgcgaagcggtattgacggcatggcctggcgaggcgccgcgcttcgatcagaaagtcttccagcgtcattgaatgtcgtgctcccggtttccggcaccgcgggtgccgcatggatgcgtcgggccgccgcccgcatcattcggcttcggcctgcgcgcccttgcccaccgccacgcgctgcgcgcgataaatcccagcgtgccccgagaacagatacgcaacgacacacgcgacgatcgcatacacgccgatatccgccccgaacagttcgatcgccatgatcgtcgacgcgatcggcgtgttggccgcgcccgcgaacaccgcgacgaagccgagccccgcgagcacgggcaccggcagcgccagcacctggccgagcgcgttgccgagcgtcgcgcctatgtagaacagcggcgtcacttcgccgcccttgaaccccgacgcgagcgtgacgacggtgaacgcgaacttgcccgcgaagtcgtagagcggcaacgggccgtgaaacgcggcctcaatcgtcgggatgccgaggccgagatactgcggcacgttcaacgcggtcgcagccgcggcgaccagcaggccgccgagcaccggctgcagcggcgcataacggatgacgcggcggaaccacgcggtcagcgtatgcgtcgcgaacgcgaacagccgcccgaccacgccgaacgccacgcccgcgacgaccgtcacggccagccccgtcgccgacacggccggcacgaacggaatcgcataggccgtgtgatgcacgccccacgcgcggcagacgacatccgcgacgatcgcggatgcgacacaggtcagcagcgcgtcgtaccgcacgcgcccgatcgccagcacctcgagcccgaacacggcgcccgcgagcggcgtgccgaacaccgatgcgaaaccggccgcgatgccgcccatcagcagcacgcggcgatgttcgcgatcgagacggaacacgtgcgtgacgcgatcggcgagcgcgccgcccatctgcacggccgtgccctcgcggccggccgagccgccgaacaggtgcgtgacgacggtcgcgacgagcacgagcggcgccatccgtttcggcacgagcgccttcgggtcgtggatttcgtcgatcagcaggttgttgccgcgcgcgacggactggccgaagcgatggtagatccagccggtcgcgaaaccggccgccggcagccccacagcagccacggatgcgcgacgcgcgtgccggtcgcccagtcgagcgcgatcaggaacaaggcggaagccgtgccggccagtgcgccaagcagggccgagagcgcgagccagcggcacacgtagcgcacggtcgcgagaagatcggcagaagtcgtgaagaacatgatttccagattcgacggaacatcaaaacctgggcggcagaataccgcatcgacggcctgcgacctcctgacgacccaggaacacgcaggcatcatcagccgggcttaccggcggttgagggccgcaccgtgcgcaacgcgccgcgtacgaccgcagggaggcatgccatctccgcaggccgccattgtacgcgagtacgcgacgccccgcgccgcccgcaatgcggccgatggcgcagcggaacgggacggcgccgccggcccgtcgagcgccgtcagtcgcgcagcggacgcgtgatgcgcgagatcagctggggcgcgatccgttcgagcggcaggatcgccgacgccgccccgatcgcggcggccgccttcggcattccgtacacggcgctcgtcgcttcgtcctgcgcgatcgtgtggcagcccttcgcgcgcatcgccttcaggccgagcgcgccgtcgcgccccatgcccgtcagcagcacgccgaacgcttcgccctgccagccgtcggcgacgctgttgaagaacacgtcgatcgacggccggtacggtgtctcgaccggatgccgcgtatagccgagcacgccgcgcggcgacaggtaaaggtgatcgttggtcgccgcgagcagcacctcgccggcctgcggcacgctgccctgccgcgcgacgcgcaccggcagccgcgtatagccgtcgagccactcggccatcccgagcgcgaacgcctggtcgacatgctggacgatcacgatcgccgccggaaagtcggccggcagcgcgcgcagcagcgcggtcagcgcggtcggcccgcccgccgacgcgccgatcgcgacgagcgtcggctggccgcgctcgggcgcgggccccggcggcacgagcgccgcggaacggctttcgagcagccggccgatctggtcgatcttcgcgagcagcgcctgcggcgacgcgtcggccgacagcccgagcgcgagcgtcggcgtgtcgaccgcatcgagcgcacccgcgcccatcgcctcgtagaccgacgacgtgttcgcgctgacgctcgccgtcacgatcaggatcgcgcagggcgcgcgcgccatgatccggcgcgtcgccgcgaccccgtcgaccttcggcatcacgagatccatcagcacgagatcgggcggatgcgcgacgcagaaatccaccgcctcgtcgccgtcggtggcgacccacagcacgcgatggtcggtgcgcagcgcgatcacgcggcgcagcgcctccacggccagcggcaagtcgttgacgatgccgatgttcatcctcgcgcgtccccgatcaggtcgtgcacggcgtcgagcagcgcctcgtcgtggaagctgctcttcgcgaggtagtagtcggcgcccgcatcgagcccgcgacggcgatcctcgtcgcgatccttgtacgacacgatcatcaccggcacgcgcttgagcatcggatcacccttgatcagcgtgacgagttcgatgccgtccatgcgcggcatgtcgacgtcggtgacgacgagatcgaacgcatcgctgcgcaccgcgttccagccctccatcccgtcgaccgcgaccgtcacgtcgtaaccgcgcttttccagcagcttgcgttcgagctcgcgcaccgtcagcgaatcgtcgacgacgagcacgcggcgccgccggtcggccagtgccagttgcgggtcgcgcgtgagccgcgcgagctgcccgccgcgcacgagcttgtcgaccgagcggatcaggtcctcgacatcgacgatcagcaccgggtcgccgttctcgagcagcgcgccggccgcgatgttctggatcttgtgcaggcggctgtcgagcggctgcacgacgagcatccgctcgccgaggaagcggtcgaccgcgacgccgtacagctcgggttccccgccgacgaccacgaccgccgtgctcgtccgcgcgacgtcgggctccccgcgtcgagcagctgatgcgcggcgacgaggcccgcgcgccggccgtcgaacgggaaatgcggctgcccttcgagcacgtcgatatcgtcgtgcgagagttcgagcgtgcggcgcacgtgcgcgagcgggaacgcatacggctcgccaccgacctcgacgagcaggctgcggatcaccgacagcgtgagcggcagctgcagcacgaaacgcatgcccgcgcccggctcgttgaagatccgcaccgcgccgcgcacgccgcgcaccatctcctgcaccgcgtcgaggccgacgccgcggcccgacacgtcggtcaccgcatcgcgcatcgagaaacccggcagcagcaggaattcgagcagttcgggatcggacagccgcgcggccgtctcgtcgtcggtcaggcgctggcgcacgacggccgcgcgcagcgcgtccatgtcgacgcccgggccgtcgtcgatcacgctgaccagcagcgagccggcactgtggcgcgcctccagcgtcacgctcgcctcggccggcttgccgcgcgcgcgccgcgcctccggcgaatcgacgccgtggtcgatcgcgttgcgcagcaggtggccgagcggcgcgtcgagcaggtcgaggatgtcgcggtcgacctgcgtgccctcgccgacgatcgagaaacgcacctgcttgccgagcgagcgcgcgagatcgcggacgatgcgcggatacgcacgcgtcgcgtcaccgaacggccgcatccggcattgcagcgcctcgtcgtacagctgctcggcgatatgcgtgctgcgccgctcgaagcggtcgaattcgtccatgcgctcggcgagcgagcgctgcaggtcgttcagcatgtgccgcacttcgttcatcgacgcgagcatgcccgcgtcgagatcgtcggcgaattgttcatacatcaaatcgagcgagcgggctgcgtcgcgctgggcgcgcttcacgcgcagcatcgattcggcgaacggcttgagccagcgcgattcgaccagcgattcgccggacaggctcagcagccggttcagcgtatccgcgcgcacgcggcgcatcgcgccggcgccggccacgcggccggcctgggccggatcgggcaccgcgcccgagaccgcaagcggcggcaccgcggcactcgccccgacgggctcgttcgcggcaccgtcgtgctcgcgatacggcacgaccgtcggcggcgcctgcggcggacgacgcccgacacctgcatcgtctgcgcgccgtcggcgcccgtgagcgccgcggcgaacacgtcgatctccgtctgcgtcacgggctgcgcctgcggatcgccgacgcgcaccagcaaatcgacgcccgccagcagcacgtcgacgtgcgtggccgtcagcgcgatcgtgccggcctgcgcggcgacgaagcactcctccatccgccccgcgatgtcgacgccgagcggcacgccgacgatgcgcgcggcccccttcagcgaatgcgcggcgcgcatgcatgcctcgagcgcgacggaatcgggctcgcccgattcgagcgcgagcagccgttcggacagcgcctgggtctgcgtgcgcgtctcctcgcgatacagctcgagcagcgacaggtggctcaggtcgtcatcgccgctcatcgcatgctccgtgtgactgcgtcgaacaggcggtcgtcgtcgagcaggcccaccgacttcccgcgccacgacagcacgccgcgcgacaggccggcgcttgcgcgcccgaccgtggccggcacgggcacccagtcggatgcgccgaagcgcagcacgccctcgacttcgtcgaccggaaacacgaccggctcgccctggtgcgcggcgaccagcagccgcgtgaagcggccgtcgtcgccgcccttgccgcccttgccgacatcgagtccgagcagcgcgccgatcgagatcgcgatacgcagcgtgccgcggatgttgaccacgccgcgcacggccgaattgcggcgatgcggcagtgaatggatcgggcgcgtgccggcgatctcgcgcagcacgccgatcggcagcgcgagccattcgtcggccacgcgaaacgccagcgccgcatggcgcgtatcggcgtcggcgtcgcacacgtgcggcgtgccgggcgcgctcatccggcgcgtggcgtcggccatctccgccccgtcgagcgggcgctcgagcagcttcgccgcgtgatacgcgtacaccgggcagttcaggcagcgcaggcactcgttcagccgctcgcacgtgcggtcgccgcgcgtgccgatccggttccagcaatcgtcgacgtcgatcgtcgtctcgtcaatggcagcggcggcgcggttcatgaattcctctggtcatcgcggtgtcggtccccaacccgtagtcttgtcagccggccgagcgccgtgcacgctcgagcagccattgcgcgcccgcgcgatcgccgccgacgtcgagcagcgtcgcgagatgggtcagcgcttcgtgatgcgtgggccgcaggtacagcgccttcctgtagaagtcgccggcttccgatgcgcgcccgcgcgcatccgcgatcagcccgttcaggtagaacgcatcggcgtgcggcccgacgcgcgccgagaactgcgcgagcacgcgctcggcctcgtcgaacgcgccggcattcgccagcgcctgtgcgtcttccagcgtcggcgcggggccttcggccaccggtgcgcccgttgcaacaggcacaaccggttcggccgccactgccggcagatcggcccgcgcgtcgaacgcggccgcgtgcatggccggcggcggtgccgcgaacggctcgcgtgcgtcgccgagccaggccggcggcgcgaccgccagcaccgggcgtgtcgccgcgggcggcgcgaccgtgaagcgctccgcgcgccggtacggcgccgccgccacggacaacggcgccgccggccgggccgcgtaggcatcgggcgccgcgccggcaggctcgcgatgaaacgcgaatgccagcggcacgcgcgccgagcgcatcccgtgccgcatcgcgaccccgtctcggccggcccgacgaacagcacgccgtcgtcggcaagacgctcgccgagcgcgcggatcacgcgatcctgcgcgtcgcgatcgaagtagatcagcacgttgcggcagaacacgaaatcgtagcgaaggcccgtgtccgccgccggttcgacgaggttcgcctgactgaactgcacacaggcgcgcacgcgctcgtcgagcagccagccctcgcgagtcggcgtgaagtgccgcgcgcgaaactccgtcgcggtgccgcgaaacgcgttgcgcccgtaacagccgagccgcgcctgctcgatcgcgcgcgtgctgaggtcgatcgcgtcgatcgtgaaactggccgggtcgagccccgcgtcgagcagcgccatcgccgccgaaaacggttcctcgcccgtcgagcacggcgcgctcagcacgcggatcacgcggccgggcagcgccgcgagccggtcggccgcgagccgcgcgagcgtcgcgaaggcctcgcggtcgcggaagaaccaggtctcgggcacgacgaacagctcgatcagcgcacgccgttcgtcggccgacgcgttgagctgctgccagtaggcgtcgagcgcgtcctgcgtcacgggcggccgcgccgccgacgacaggcgctcgccgtccgcctgcagcgtgcacgcgctccgtcagcgcgcgggtcaggaaatcgttgccgagcgaatcggggtcgatgccggtctcgcgcagcagccagccgcgaaatcgcgattcggactctttcatgcggactctccccgtggcccggcaggccgtcgtcgaacagatacaggcgtgcaacgtcgtcgatcaggtcggcaaccgatacctgctgcacgacgccgtcgggcgtattcgcgacgggcccgagccagcgcgtgcgcgcggtcgagatgccgctcgcgcgaaacgccgcgcggtcgatccgcatcgtctgcgtcgcacgctcgacgatcaacccgatcgtgcgctcgccgcccgcctcgtgcgcccggtagcggaccatcacgagccgcgtcgagcgcagcgcatgcgcgcggcgcccgagcgccagcatcggcacgtcaatcaccggcaccggctggccgccgcgcatcagcagcccggcaatccattcgggtgcgccgggcacggccttcgtgaccgcgagcggcagcacctcgtcgatgccggccgcgtcgagcgcatagcgttcgccgtcgagctcgaacatcaggaacagcgcatgcgcgccgttctgcgtgtccgcgcgcatcacgcgtcgaccttgaagcgcgacacgctggtgcgcaactggttcgcgacgagcgtcaggtcgtcgatcgcctgcgacgactggcgcagcgactcggccgtctgctgcgcggcctccgacagctgcgacagcgcctgcgtgatctgctccgcgccgttcgcctgcgtctgcatcccttcgttgaccatctggaagcgcggcgagagcgtctgcacctcggcgatgatctgcgacagctgcccgccgacctgctgcacgtcgagcatccccggcgcacttcctcggagaacttgtccattcccatcacgcccgccgataccgccgactggatctccttcaccgtctgctcgatatcgtaggtcgcgaccgccgtctggtcggcgaggcggcggatctcggtcgcgacgaccgcgaagccgcggccgtattcgccggccttctcggcctcgatcgcggcgttcagcgacagcaggttggtctggtcggccaccttggtgatggtcgcgaccacctggttgatgttcagcgccttctcgttgaggatcgcgagcttcgcgttcaccgagccggccgcgtccatcacgctgcgcatcgtctcgcccatccgcgtgagcccgctctggctcacgcccgcgagtgtggccgactgctccgccacgccggccacttcgttcatcgtgcgcaccaggtcgcgcgacgtcgcgaagatttcgcgcgaggtcgcgccgatctcggtcgtcgtcgccgcggtttcgttcgcggtcgcctgctgctcgcgcgacgtcgccgcgatctcggcgaccgacgtcgtcacctgcagcgacgactgctgcgcacgcgcgacgagctcggtcagttcgtcggccatccggttgaagcccgtctcgagcgtgccgaattcgtcgcggcggcgcaggtcgaggcggcgcgtcaggttgccggtacgcatcacgtcgtgcacctcgacgagccgcgccatcgggacggtgaccgaacggtacagcatgtagccgaacccgagcgcggacagcagcatgatcgccagtgcggtcgcgagcaccacctcggtgtcctgcacggattcacggatcagcttcgccgactgatcggcgaacttgcggttttcctgcacgagaatattcgcattgcgcacgacctcggcccatgccggctgcaccttcacatacccggcgaccgcgtcgtcgtgcgattgacggtgccgctgcaccgcttcgttcagcagcggcaggtagtggtcgtaggtgccccggaaagtcgcgaagcgctgccggtcgtcgtcgcgaaatatcgagttctggtactcgaccgacaacgaatcgatgtccttcgccgcttcggcgatcttcgcgagatcgcgctggacgctttcgggatcggtctcgacgaacgtcgcctgctgcagcagcatgaacgattcattcactgcgccgcgcagcgacgacgcgaggtagacgccgggcagcgaatcgcgctcgatgctgacggcttcgctgttgatcgcacgcaatcgctcgtaggacacgccggctgtcaccagcatcagcacgaacagcacgccgaagctgagcaggatgcgattgccgagcgtcagccgggcagcgccgatcgtcggatgcaggctttcattggtcgcgcggggcgtcacggtggccatgttcgttatgggctttctaatatcagcgttgaaaaatccgcgcccgcctgcgcgccggacggcgcgccacgagcgcatcagggcttgcaggcggcgcggcgccggcaggccgcgccgcgaaatcaccgctccgcttgcgccggcagccgaagcgcgaccatgaagccgcgcgccgtattgcgcatcaggatctggccgcgatgccgcgccgccgtcgcgcggacgaacgcgagcccgaggccgaagccgccgcgcgccgcgccatgcgcggtctcgagctgcacgaacgactcggtcgcggccgtgcgctgctccggcgcgattcccgcgccggtatcctcgacgccgatcagccatgcaccgtcctcgccgctcagcgtgcagtgcacgtccgtgccggccgggccgtacttcagcccgttgtcgatcaggttcgcgaccgcgcgcgtcagcatcatgcggtcgcccatcgtcacgcactcggtatcgggcacgtgcgcggtgacccggctgccgagcccggccgccttctcccacagctggtcgacggcgtcgagcacgatctcgttgaggctcacgacctcgtgcgcgcggcgctcggaccgcgcgcgggtcaggtggatgaagccgtcggcaagcgcgagcgcgcgccgcgcatggccggcaatgcgttccatgatcgccggcatctcgccgtgctcggcgcggtagacgtcgagcagcgcgaggatcgacgtctgcggcgaacgcatgtcgtgcgacaggaagtcgagcgcctcgtcgcgctgccgggacatcaggtacgaattcgagtgatagcggatccgtgcggccagctccatcgcgtcggggagcttcaccagatagtcgttcgcgccggcgatgaacgcctcgcgcttgacgatcggctcctccttcgcggacagcacgatgatcggcacgcgagccgtgccggcgtccgcgcgccacgcacggacgagatcgaggccgtcgatctccggcatcacgagatcctgcaggatgaccgtcggcttcacgtcgcgcgcgaccgccatcgcccggtgcgcgtcggtgcacacgtgcaggtcgatgtcgtgttcgctgcgcagcgcgcggcggatcacctcgccgacgaacggttgatcgtcgacgagaaggaccgataaccccgattcaagacaatccgaggcattatcaacgctcgattctttcataaatacagtttcaaacgccgattctccaatcgattctttcataggagttgtttatcagacttgggacgctatcttaattcggcggttgaaaaaaccgcccgattccgccgatttggcctgtcggcattggccttgcagggctccggacgccgatttctccccgttggcggccgcattacctccgcatcctttctctcaataaacataaccggctgattctaaatgaaattagaacacagcatctatctccttccggtttagttttgccaaatatgcagaaagagacggaatcagttaaatcagatcatttccggattcgaaagacgataacgtttgcgagaccggtgccataaggtttgcatgcgctgcaaggctggtcgcccgcctcatttggggccggatggaaatgcgccgaatcggcgggcgcgaggaagaaaaagcgcgccgggcaacgatctgcccatgcgcgcttccggtcgaccggcaccggccgccggatgacggcatgacggtgccgtgcagccttatccgcgcgcgtgctgcgcggacacttcctgcaggtcgaggtcgcgttcgagcgcgtgcagcatttcgtcgtggatgcggcccgaacggtgcaggcgcaacaattcggcgcgcccggccctgatcgcggccagcacgacgtcgtagtgcgcggtgcgcacttccgccgggtacgccggctcgtccttcgcccgttcggtcaattccgcgcgatacgtgtactgctcgagcaggcgcggatggatcacgaccccgttctcgtcgcgcacgagcggctggatcgccgcgagttgcgcggcctcgacgtacgcccacgtctgcggctcggtcaggtggtgcgccgcgcgctcttcgcgctgcggcaggcgcagcagccggatcagcggcccgatcgtcgtgccctgcagcagcacggtgacgaggatcaccgcgaacgacgcgaccaggatcacgtcgcggccgggcatcgcctcgggcagcgacagcgcgatcgccagcgtgacgacgccgcgcatcccggcccagctcatgatcgtcgcggccttccagtccggcgcctcgccgcgccgcgcgatcccgcgcaccggccatttcagcgcctcgaccgcgtagatccacacgaagcgcgacacgatcaccgccgccagcaccgcgaacatcggcggcaccatcgtggcgagcacctgctcgaagccgccgagccggtggatcgcgccgcgcagcgacagcccgatcaacacgaacaccatcgcttcgagcaggaacacgatgacctgccagaacgcggtgccgcgcgtgcgcacagccgccgagaacacctcgtgctgatgccagccgacgatcatgccggccgtgacggtggcgatcacgcccgatacctcggccatttcacccgcgatataggcgatccagccggtgatcaccgcgacggtgatcacgagatagtcgtcgtcgagctgcttcaggaaccacacgacgagcttgccgaccacgaagccgatcgccacgccgccgagcccgagctccgcgaagcgcacgaccgcgtgctcgaggctgaacgcgccggtgagcgcggccgcgaccgcgaagcggaacagcacgaggccggccgcatcgttcagcaggctctcgccttcgagcagcaccatcagccggcgcggcagcgcgacgcgttcgagcacggccttggccgcaacggcgtcgggcggcgacacgatcgcgccgagcgcgaagcacgcggcccacggcagcgacggcgccacccagtgcacggcgaagccgaccgcgaacgtcgtgaacacgaccgcgccgatcgccagcagcaggatgccgccgacgttgcgcttgaactcctcccacaccgagaagtacgcgccgtccatcagcagaggcggcaggaacaccagcagcaccagttcgggatcgagatcgatcggcggcaggccggggatgaacgcgatgccgatgccgccgatcagcagcgcggccgcgggcggcagccgcagccgcttggcgacgcattcgagcgcgacgatcgcgagaaatgacaacaaaaccagcttgaatgccgagacgggagacatgaatcgacctcatgaagaatgaattcgcgctttccggcgtcgtaccccggtcggcagtttcgcgcgattacatcacgaggcgagtcccgtagtcgagcgcgttccggcagcccgccacgcgacgccacgcgggcacgatacgggcccgacagggcccggtgccggcccgctgcgcgcgacgccatgaaaaacggcacgcgggccggccttgcgcccgcccgcgtgccgtcgcggcaccgcgcatcccgccccgcgttaccggcgccgcacgaccatcagccgcggctcggtcatgtcctcgatcgcgtagcggatcccttcgcggccgaggcccgaatccttcacgcccccgtacggcatgttgtcgacgcggaacgacggcacgtcgttgatcacgacgccgccgacctccagctcgtcccacgcgcgctgcgcatgcgtgagcgaatcggtgaacacgccggcctgcagcccgaagtcgctgtcgttgacgcgggcaagcgcatcgtcgaaccggtcgaacttctcgaggatcgcgacggggccgaacgcctccttccggtacaggtcctgctcgtgcccgacgttttccagcagcgtcgcttcgaacatcgcgccgtcgaccttgccgcccgcaacgatcttcgcgcccgccgcgacggccgcgtccatccatcccgacagccggcgagattcggattcggaaatcatcggcccgacgaacgtcgacggatccttcggatcgcccatcttcagcgaacgcgtctttgcgatcagcttctcgcgcagcgcgtcgtaaagatcggcatggacgaggatccgctgcacgccgatgcagctctggcccgactggtagtacgcgccgaacgcgaggcgctcgaccacgtagtcgagccggtcgcgttgatccgcatcgacgatcgcggccgcgttgccgccgagctcaagcacgactttcttcttgccggccttctccttcagcgcccagccgacggccggcgaccccgtgaacgacagcagcttgaaacgctcgtcggtcgtgaacaggtcggcgccgtcgcgatgcgcgggcagcaccgagaatgcgcccttcggcaagtcggtttcggcgagtacctcgccgatgatcagcgcgccgaccggcgtgcggctcgcgggcttcagcacgaacggacagccggccgcgagcgcgggcgcgaccttgtgcgcggcgaggttcagcgggaagttgaacggcgagatgaacgagcacgggccgaccggcacgcgcttcgtgtagcccgtatagccctgcgcgcgcgggagatctcgaggttgatgatctcgccgtcgatgcgcaccgactcctcggacgccacgcggaacgtgtcgatcagccgcgtcacttcgcccttcgaatcgttgatcggcttgccggcctcgatgcacagcgcctcggccagctcgtcgaagcgctcgcgaaaacgggcgacgcaatggtcgagcacggcctgccgcttgtaggctggcagctcgcgcatcggcttcgcggcgtcgaccgcggcaccgatcgccgcgtcgatggccttcgcgtcggccagcgcgacgcgcgtcgcgaccttgccgctgaacttgtccgtcacgtccagatcggtgttcgcgtagacggcttcgttggcgaggtagtacggataggtttccttcaacatggaacgactccttcctgtggacgggacattcagagttgcgccgacaggcgcttgatctcgcggttcagcacgcgctcgttgtccgaatagtcgatcggcacgtcgatcacgtgcacgcccggcgtcgagaaacactcgcgcagcagcggctcgagatcgtcggccgattcgacgcggtgcccgtgcgcgccgtagctttgcgcatacgacacgaaatcggggttctgcagcgtcatcgcgaaatcggggaaattcatgttctcctgcttccagcggatcatcccgaaggcatcgtcgcgcaggatcatcacgacgaggtcgagcttcagccgcaccgccgtttcgagctcctgcgaattcatcatgaagccgccgtcgccgcacacggcgatcaccttgcgctgcgggtgcacgatcttcgtcgcgatcgccgacggcaggccggcgcccatcgacgcgagtgcgttgtcgagcagcagagaattcggctcgtgcgcgcgccagtagcgcgcgaaccagatcttgtacatcccgttgtcgagacagacgatgccgtcgaccggcagcgcgttgtaaagatcgttgacgatccgcaccgggtacatcgggaagcgcggatcgtgctggcccttctccagatgggcgtcgaaatgcgccttgatcatcgtgaagcgcgagaaatcccagtgcggctgcggcgcgagcgcctccttcatctgccacaccgcgttcgcgatgtcgccgaccacctcgatctgcgggaagtagacgggatcgacctgcgcgccgaggaagttcacgtggatcacggtcttgtcgtcggtacgcatgaagaacggcggcttctcgatcacgtcgtggccgacgttgatgatgcagtccgcatgctcgatcgcgcggtggacgaagtcgccgtcggacagcgtcgcgttgccgagccacagcgggtgcgtctcgtcgatcacgcccttgcccatctgcgtcgtgaagaacgggatgcccgtcttgtcgacgaattcgagcagcatcttgcaggtggtcttgcggttgccgcccgcaccgatcatcagcagcggatggcgtgcggcctggatcgcgtcgaccgcatgcgcgatcgccttttcctccgccaccggccgccggctgtagctgcgcgggatcggcttgccgtcgccctcctcgtgcgcgatgtcttccggcagctcgaggtgcgcggcgcccggacgctcctcctccgcgcggcggaacgcctcgcgcacggccgacgggatgttgccgatcgacacgatctgccgcgtgaacttcgtgagcggctgcatcatgtcgaccacgtcgacgatctggaagtggccctgcttgctggacttgatcggcttctgcccggtgatcatcagcatcggcatcccgccgagctgcgcgtacgcggcggccgtcacgaagttcgtcgcgccgggcccgagcgtggcgatacacacgccggtacggcccgtcaggcggccgtaggtggcggccatgaacccggccgcctgctcgtgccgggtcagcacgagcttgatcttcgatcgccgcagcgattcgagcagatcgaggttttcttcgccgggaatgccgaacacgtactcgacgccttcggcttccagcgccttcacgaacagatccgatgctttcatggggactctcggttgatgccgcctgcccggcctacggacacgcagcgttcagaacgcgcgccggcctacggcacgcggacgctttacctactggacacaaaccacggcactgcccgccgcgcaacgagcgatgcgcggcggcgcctccggatagcggaggacaagcggatccgcccgcgcgcggcaagcgcgcacgggcggcaaagacgtgattgattgtagacggattcgcagaactccgacttcggccgaacggccatttggcacgcaaacgaagcgggcagccctaatgtagcggctaccgaataacccgacccggcccaacccacctgtgaaccatggttgacataccgcaatcaatgccctacagtgcgcctacgttcagcatccgaccaccgacgtcttcgacgcatggtttgccggcctgcgcgatcgcgtcgcgaagcgccgcatccaggcacgcatcgaccgcctgtcgatgggcaatccgggcgactggaaatccgcgggctcgccggtcgtcgaaatgcggatcgaccacggccccggctatcgcgtctactacgtccggcgcggaacgatctgggtcatcctgctcggcggcggcgataaatcgacgcaacaggccgacatacgcgccgcgcacgcgatgctcgcgcacctcgacatggagtaatcgatggacaagatcagcacccggccgtgggattcggccgaccatctgaagaccgaagacgacatggccgactacttcgaagcgtgcctgcaggaagccggcgacgatccggccttcatcgcgcacgcgctcggcgtgatcgcacgcgcacgcggcatgtcgcaggtcgcgcgcgacgcgggcctgtcgcgcgaagggctgtacaaggcgctgtcgcacgacggcaacccgagcttcggcaccatcctgaaggtcatcaaggcgctcggcctgcaactgcacggcgcgaaagcgcatgcatgacgcgcgggcgcggcccgtcgcaccctccgcgccctcccgcgatacccgtggccgcgtcagtgcagccagccggccgcccagcgcggcaccagcgacaccagatacaacccgagcccgatcagcccgccgaccagcgtgccgttgatgcggatgtattgcaggtccttgccgatgttcagctcgatctgccgcgacatctcgcgcgcatcccagttgcgcaccgtatcgcggatatggcgcatcaggaaatccgcgaaatccggcgccatctcgtgcacggccttctcgacatgctcgttcagcgatgcacgcaatgccggactctccgccagccgcgcaccgagccagccgccgagcgtcgccgcctgccggtgcagcgccgaatcggggcgcgcgagatcggccttcagccacgcgcgcaactgatcccacaagtcgcggacatactcgttgaacgcggcaccgtcgcgaacgtaacgcttgatctcctcgcccttcgcgatgaacgcgggatcgtgcttcaaccgctcggtcagccgcacgaccgtccggtcgaagcgctgccgcagctcgtgctcggggtcggccgccacgccttccagcacgcggctcaccgcgctcgcgagcatccgcgcgccgttctcgccgaaccactgcgtcggcatgatcttctcgaccttcgggtactgcgtcttcagccattcgacgatgaaacccgcgatcacctcgcggttttcctccttgtcgagcacgtcgaccacctgttcgatcgcgtcgtcgagcagcacctggtggcggccgtccttcgtcagcgtgtcgaggatcgcgccggccgattgcgacaggtcgacccggtcgatcaccgcacgaaacgcatcgtggacgaacgactggatccgcgcgtcgtcggtcatgtcgagcgcgaaactcatcagcttcgtcacatagccgccgagcgcgtcagtgtttgccggctcgccgagccacgcgccgagtttctgcgcgggatcgtgctggcgaatctgcgcggcgagcgcgtcgggaccgaggaacttctcgcgcacgaacaccgcgaggttgtcggcgatcttgtccttgttcttcggaatgatctcggtatgacgcgacacgaacggaatcggtacacggcggaacagcgcgacgaccgcgaaccagtcggcgagcgcgccgaccatcgcggcttcggccacggccttgaagccgtcgacccacgggccacgcggcagcaggatcgtcgtgacgaacaccgcgacggcggccagcagcagccacagcgcgcggcgcttgctgcgtttcagttcgagggctttgtctggcgtcatggcggcaggcgaatcggcgatgccgctaatatccccgatttcgcaccggccgacaaacgcgcggcatgaaacgcgacggccccgcgcgatcgccgccgggcatgacgtcacccgccacgtcgcgcaatcgtccggcaagcgcgcggccggcgacgtcgtcgccgacgccatccgtccgccgcgcccggcatactcgccgcgcctgccgccgttacaggaacgtcttcagattcaccgtcggatcggcgagcttcaccggatcgggcaccgccccggccgcgatcagccggcgcgatgcgccgatgtcgcgccctggttcgccgcggccgccgcgacgatcctgccgtcgtccccagcccgaacaccgtgaatggcccgttcgccggatcgccgcgcacgacgatcgtgcgttcgctgccgaacaacccgagcatctgcaggttgcagtcgtactgatcggaccacaaccacggcagctcggcataggcttcgtcggcaccgagcaggttcgccgccgcgacggccggctggttttcggccacctgccacgattcgatccgcacgtgacgcccgagcaacggattgaagtgcatcgtcacctcgcccgccgcgaagatcgcgggatcgaccgtacggcagcccgcgtcgacgcgtatcccgttgtcgacatcgagccccgctgcgtgcgcgagctcgacattcggcaccaccccgataccgaccacgacgagatcggccggcacatcgccacgatcggtctcgacgatcgtgccgccacccggcgcgcgacggatcgcgcgcggcagcgtcgccatccggaagaccacgccgcgtgcgtcgtgcagccgatgcgcatacgcgccgacgacttccggcaacgcgcgctgcagcaggcgcggcgccggatcgatcaccgtcacgtcgcaaccgagctggcgcgccgccgccgcgacctcgaggccgatgaaaccgcccccgagcaccgccacgcggcgccccggcgcgagctgtgcgcgcaacgcacgcgcatcgtcgaccgtgcggacgtaatgcggcgtgacgccttcgtcgatctcaccgccgaacgtacgcacccgcgagcccgtcgccagcacgagccgcgcataaggcagcgtcgtgccgtcgtcgagccgcacgcgcaacgcatcgcgctcgatcgcctcgacgcgcgtgccgagccgcagctcgatgcgctgcgcgtcgtaccacgcggcatcgcgcacgaacgcacgctgctcgccgccgtcgctcagcagcgcatccttcgacagcgcgggccggtcgtacggcagctcgcgttccgcgccgatcatcacgatgcgcgccgcggcgtcgcgctcgcgcaccgcttcggccgtgcgccgcgccgcgtggccggcgccgacgatcacgaacggatcagccgacattgacttccacctgcccgtcgacgatccggatcggataggtacgcaccggctccgtgatcggcgcgcatttcggcgcgccggtgcgaatgtcgatcagcccctggtgcagcgggcattcgacgcagccgtcctccacatacccctcggacagccgcgcatggccgtgcgtgcagagatcgtgcatcgcgaacagttcgtcgccgatccggaacacggcgatcggcttctggccggcgacgcgcgccgccggttcgtcttcggagaattcgtcgaaagcgccgagcggatgccactcggcgagcgttgcttcagtcatgactgttccttgcttccgtatcagatcggggtcgcgagcagcgtctgcacgcgcgacgtgtcgtagatcacccgcttggtcttgtagcgcagcccgtccggcgtgcgcacgaccgtgtcgtagtacttgccggcctggtacacgttcgactcgccgttgctgcgcgtctgcacgacgacgtagttgctctcggtgtcgatctcgccgtcacgttccgcgacgatcgtcaggcccgacgtcatgtgccggtacgtatgctcttcgtagatgttcgcgtgccgcagcgacaccacgcggtcgcgcagcatccgctggttcgtgcagtggacgatcccaaccggcagcccgaggtcggcgttttccttcggcacgatttcgtacgtgcagtcctcggtgaacatcgccggccattcctcgagccggttgttgtcgaggtgcccgatatagcggttctggagcatgtaaatctcgaaccacgtcttcatgtcttccgtcaggttttccatcgttccgcgctcccgcttcaatagcccatcagcttctggtagccgacccagaacttgcggatcaggctttcggtgatcaccgtgtcctgctggtccggattgccgcgcgacatctcgatcaccgacgtcgcgtcgccgtcgcgcaccgtgccgcgctgcacgagctcggtcgcctccgtgtcctccatcgagatatagccggccggcccgacgaggttcgcctgcttgatacgcagcgcgcgcagctcgggcgtatcgtccgcgtagccgaagaagtggaagatcagctcgaagttgtcggggcccttcggcaggatctggcgggcgaccagcgtgttgtggatctgctggatcacgagctgcgggaagatcggctggatatggttcgtgcagtcctcgtcgtattccgacacgagatcgagaatcgattcgtcttccagatggaaaccttcgtcgaacgagcgaatgttctgctgcttgtacgcggccgacgtatcgtcgcccgtcttcgtcaccgtgatgatgctgtgcagcccgtggttcgcatccggaatcgagcgcgccttcatcccgacgcggaagatgttgaaggtcgtatggaacaggtgcagcatgctcgcgtgatacgggtccttcacgttctccatgtacagcttccagttcgacttcgaatactggcgcgtgcagccgagatactcgatcggcttgtggaagatccggtcgatccacgggcgcatctgctcgccgagatagtcgggcagcggcatcacgtcgtcgctgaaggtggcgaacacgagcccgcgatagctgtcgacacgcagcttgcgcagcccgtgctgcttcgggtcgaagtcggccggcatcccggacatccccttctggccgcgccggaacggcacgccgagcaggttgcccgcgttgtcgaagctccactggtgatacacgcacgtatgcgagctcgcgttgccgcgcgacttgcggcacacctgcgcgccgcggtgcgcgcagcggttcacccacgcggaaagcgcgccgtcctccgtgcgcgtgacgaccaccggcgtatcgccgacgaacgtgctcttgaaatcgccggcgttcgggatttccgcttccagcgcgacgaagttccacgtcgggccgcgaaagatgcgttcctgctcgcgttcgtagacggcctgcgagctgaacaccttgtacggcacgcgcgagccgtcgtcgtgcggaaagctcacgtcggacgcatcgtcgcgcgaggcgaacacgacgggcgattctgtctgctccatgtcggactccttgtggttccgtttcattaacaagatggagtccatttttgaaaggctaatattccccgtctatccggaaagtgcgattgcggcggcgcaatatccactttcggcggatttctgagctagcatgacggcacacacgaccctgcgcacgatcgcgacccattcatcggatcgaagcgcgcgtcgctcatacaaaggctgaggcccatgtccccaacgtcgttcgagccgctcgcgctgcgcgcgcaccggctgttcgaatcccgcgatctcgacgagacgcgcgagcgaatctcgcgcgtgatgcagccgcatgcgctgctgccgaacggccgcacgcatggcgcgtcgcacatggatttcgtccggctcggcgggctcgggatcggcacgatcgcattcggcgacgcgatgcgcgtgcaggtcgacgcggtcgacggctactacctgctgatgttctgcctgtccggccaggccgaggtgcgcgcgatggggcggcagctcggcgtcgacggccagaccggcgtgctgtgcgcgcccggcgagcgcttcgacgcggtgctgtcggccgattgcgagcagttcgtgctgcgcatcgacgcggccacggtcggctcgctgacgggcgacccgcgcgcgacgctcgacccggtgctgcatgtcagcgacgccgcgctcaccgcgtggcgccagcaactgatgctcgtcgcccgctcgcccgagctgctcgagcgcgcgaacgcgaacccgcgcgtcgcgtcgcagctcgagcacctgctgatcgacctgctgatcgaaggccacccgccgtccgtgctgcacgcctcgcaccgcgaccccgcgccgggcttcctgcggcgcgcgcaggagttcgtggacgcgcactacgcgcagccgctgcaactcgccgatatcgtccaggccgccaacgtgccggaacggacgctgcgcgacgcgttcctgcagttccgcggaatgagcccgatgcaatacctgcgcgcgacgcggctcgaccatgcgcgcgagctgctgcgcggcgcggcgtccgaccggcggatcgccgatgtcgcgctcgattgcgggtttacgcaccttggccggttcgcgatcgcctatcgggaaaaattcggcgagtctccgtctgaaacgctcgacgtgaagcgatagcggcgcgcacgctggcgcggccggtggcatgcggcttgtggcctgcggcatgcggcatgcggcttgtggcttgtggcttgtggcttgtggcttgtggcttgtggcctgcgacccgcaaaaccagcgcagcacttccatcgacgcgcgtgacattacgacacccctccgcatccaccggcgcacgccgaaacagaccgttagttgcgatgcctgaaagcggcgatgcccgtcaggccgacgccccgatcatctcccgcgcaatcgcgcagaacgcggccgtggcggcgctttcgccgtgcagccggcggctcatgatgatcggcgacgtcgcggccggctccggcaaccgccggtagaccacgcccttcacgcgcacgccctccacgctctccggcaccagcgacacgccgacctgcgcggccacgagcccgagcgccgtctgcagctcgcgcacctcgtgcacggccgccggcaccagcgcgccgtcgcgcagcgccgacagctgctgatcggcgaagctcggccgcggcgtgctcggatagacgatcagcgtctcgttcgcgatatccgcgagcgcgagaggccgatcgggatcggcgagcggatgcccgaccggcagcgcggcgatcagcttttcctcgatcagcgcctcgcgcaccagctggtcgtcgtcgaaccgcaggcggccgaacccgacgtcgatccgcccgcccttcagcgcgccgagctgttcgagcgtgaacatttcgatcagcgacagttcaacgtccggctgcgcctcgcgaaacgcgcggatcacgtccggcagcgcgccgtacagcgtcgacggcacgaagccgatcacgatccgctccgacagctgcgcgagccgccgcgtcagcgggccgagctcgtcagcctggtcgacgaggcgcttcgcctgcgcgtagaacacgcgccccgcatccgtcagcttcagcggccgcgcgccgcgctcgaacagcggcagcccgatctcgtcctcgatcgcctggagctggcggctcagcggcggctgcgtcatgtgcaaccgctcggccgcccgcgtgatgttcatttcctcggcgacggcgatgaagtagcggagctggcgcaattccatttcatgcctcaaaggtatggaagtagtcggaaagagtgttggacgacgcggggcgggaattcctaccatgtgcaccaacaggaggaatcgcatgatagcaactgccgccaccatcgaacgcatcgagactttgctggtcgacgtgccgacgatcaggccccacaaattgtcggtcgccacgatgaattgccagaccctcgtactggttcgcgttcgatgcacggacggtatcgaaggcgtcggcgaggcgacgaccatcggcggcctcgcctacggcgaggaaagccccgaaagcatcaaggtcaacatcgacacctacttcgcgccgttgctgcagggcatggacgcgacccgcccgggcgccgcgatggcgcgcgcccgcaagctgttccagggcaaccgcttcgcgaagtgcgcgatcgagaccgcgttgttcgacgcgcaggcgcgccgcctcggcgtgccgctgtcggaactgttcggcggccgccgggccgacgcggtggacgtcgcatggacgctcgcgagcggcgacacgcagcgcgacatcgcggaagccgaagcgatgctcgacgcgcgccgccaccgcgcgttcaagctgaagatcggctcgaacgcggtcgccagcgacgtcgcacacgtcgtcgcgatcaagcgcgcgctcggcgagcgcggcgacgtgcgtgtcgacgtgaaccaggcatggagcgaaaccgacgcgatctgggccggcgcacggctcgcggaagcgggcgtgagcctcgtcgagcagccgatcgccgcgaccaaccgcgcggggctgaaacgcctcacgcagctcgcgcaggtgccgatcatggccgacgaggcgctgcacggccccgtcgatgcgttcgcgctcgcgcaggatcgcgcggccgacgtgttcgccgtgaagatcgcgcaatcgggcggcctgcagggcgcggcgagcgtcgcgtcgatcgcggcggcggccggcatcgagctgtacggcggcacgatgctcgagggcgcggccggcacgatggcgtccgcgcaactgttcagtacgttcgactcgctgaaatggggcaccgagctgttcggcccactgctgctcaccgaggaaatcctcgtcgagccgctacgctacgaggatttcaagctgcacctgccggcgacgcccggcctcggcatcaccttcgactgggcccgcatcgaacgcttgaagcgcgacgcccgctgatccccacacgacaaccgaaaccggagacacacatggacaagcaagccatcgacgccctgctgaagacgttcgacgacgccgcggagaagcccggcaacccgcgcgtgcgcgcgatcgtcaaccggatcatgaaggacctgtgctacacgatcgaggatttcgacgtgcagccgagcgaattctggaccgcgctcaactacctgaacgaagcgggcaaggagctcggcctgatcgccgcgggcctcggcctcgagcgcttcctcgacgtgcggatggacgaagccgaagcgaaggccggcatcgagggcggcacgccgcgcacgatcgagggccgctgtacgttgccggcgcgccggaatcggtcggccatgcgcgcctcgacgacggcaccgatccgggccagacgctcgtgatgcgcggcaaggtgctcggccacgacggcgcgccgatcgcgaacgcgctcgtcgaggtgtggcatgcgaaccatctcggcaactactcgtacttcgaccagtcgcagcccgcgttcaacctgcgccgttcgatccgcaccgacgcggaaggccgctacagcttccgcagcgtggtgccggtcggctacagcgtgccgccgggcggcaagaccgagcaactgctcgaccagctcggccgccacggccatcgtccggcgcacattcacttcttcgtttcggcggacggttatcgtaagctgacgacgcagatcaacatcgaaggcgatccgcacctgtgggacgacttcgcattcgcaacgcgcgacgggctgatcccggcagtgaagcaggccgaaggcgcggaaggcaagccgtacggcgtcgacgggcagttcgcgctgatcgacttcgatttctcgctgctcaaggaaaagcaggacgtgccggcaagcgaagtcgagcgagcccgcgcgcaggcgtgagcggccttctcgttcgacgaatcgacaacgcaaggagtgcaggatgctgtttcatgtggaaatgaccgtccgtctgccgacggacatggatccggtcaaggcggccacgctgaaggcggaagaaaaggcgatgtgccagcggctgatgaacgaaggtgtctggcgtcatctgtggcggatcgccgggcagtatgcgaacgtcagcatcttcgacgtcgagagcgtgcagcaactgcatgacctgctgagccagttgccgctgttcccgtatatggagatggaagtgcgcgcgctgtgccggcatccgtcttcggtgcgggaagacgatcggtaagcaggcgatcgagttccgacaagacgggcggcccgcgattgcatcgcgggccgcccgtttcgtttcgtcatccgccggggtggatcgggttgccgcgcggccggcttccgcgcatccgtcgcgccgatctccggaaacggcgcgattcgcgcgcaggtgtcgatatgcccgcgcgccgctttcccgagcgggcccgcctgcgtcatcaatacgcgtgcgccagatgcgcggcaaaccccaccgtccccggcacgatctcctccttcagcgtcaacgccggaatctcgtaatcgcccgcgttctgtcgccggaacggaatcggctgcgcggtccacaacgcatcgaggcgcttgccgagcgccgcacgcgtttcgtcgaagcgcgcgtcgttcatcttgcccgtccggtagatcacgaacggcggcagcacgtcgaaccccgggtaatacaagatcccgtgctggatcggaaacagcacgtcgtcgatcggcccgttgatgccgcgcgggctgtagtgcgattcccacccgcctgccgtgacgatcagcatcgcccgcttgccggccagcgccccttcgccgtagcggttgccccagcgcgtctccgaatgctcgccgacgccatacgcaaaaccgtacgcatacacacgctcgacccagcccttcatgatcgccggcatcgagaaccaccacagcggaaactgcaggatcaccgcgtcggcccacttcagcttctcctgctcgcgcgcgatatcttcgctttgcgtgccggccgcgaatgcgtgcttcgagtcgagcgacggatcgaaccgcgcgtcgggtgcgcgaccggtcacgtcgttcgcgtcgaacgccgccttccagttcatcgcatacagatccgtcacctgcaccgcgtggccggctgcttcgagatgctcgacggcaaagtcgcgcagcgcgccgttcagcgaacgcggttcgggatgggcataaacgatcagcacattcatgttcgtcactcctttgattgaatgactacaggatgccgccgtcgaaggtatatttgaaatgaattcctgatattccaggtatagccatgaataatctcagacgactcgacctgaacctgctcgtcacgctggacgtgctgctcgccgagcacaacgtcacgcgcgcggccgagaaactgaacatgtcgcagccgtcggtgagcgtgcagttgcaaaaactgcgtgacctgttcggcgatccgctgctgttgccggggccgcgcgggatgcggccgaccgcgcgcgcggaaacgctgcgcgagccgttgcgcgatgcgctcgaagccgtcgagcgcgcggtggttccggccgcaccgttcgatccggcgaccgcgacgaacacgtggcgcgtggccgcgaccgactacggcgaatcgacgatcgtgctgcccgcgctgaacacgctgcgctcggccgcgcccggtacgcggctcgccgtcgtcgaactcgcgccgccgcgcatcgagcaggatgccgaacgaaacggcatcgacctcgcctttcatacgacggaagggtcgccggccggcatgcggcgcctgccgctgttcgtcgagcgttatgtgctcatcggccgcgccgggcatccgaagctgaagcggcgcccgacgctcgcgcagttcggcacgctcgaacacgtgatcgtgtcgcccgatggcggcggcttcttcggcgtgacggacgaagcgctcgcgaaggtcggggccgtgcggcgcgtcgtgctgtccgtgccgcacttcctgttcgtgatgtcggccgtcgcgagcaccgatctcgtcgcgatgctgcccgagcgactggtgcgcgacgtgcctgcgttgcgtgtggtggacgcaccggtcgaggtgcccggctatgaaatgtcgatgctgtggcacgagcgcgtgcatcgcgatccggcgcatcggtggctgcgggagaccatcgcggcggcggtctgacacggcccggttgccggacggctgccatctgctgtcatcgggggcttgaaagtgcgccgatcactgtatatatttacagtgtttctgcgtcatttgacccgaattccgtccccgagacggtctttagtgaggcgaccatgttccagtcatccgcattcgatcccgagcaacccggcttcaatcccgtccacttcgagcgcgccgcgcgcaggcggtcgtcgatcttcagcgtgtcgtcggcggccccgcgcagcgggcgctcggcttgcggcgccgcagccatccggccgccgtccgcacgatgagctggcaggcgctgctgaatgtcgaggagctggcgttctcgaactccggcttcctgaaccgcaacgatccgacggtcgtcgacgccttcatccggctgcgcgacagccggatggtcgccgcggacgtcgaggaagccgtcgactggaagcgcgacgacgacgatttgcccgccgtttatctgatcgtcaaggcgatgctggaagcggaagagcgcgagacgcaacacgccgagatggagtgacggcggcgacgcgcggccgtcccgttacagccgtgccgcgaggcgcgcaccctgatcgatcgcgcgcttcgcgtcgagttcggcggccagttccgcgccaccgatcaggtgcacggaacgcccggccgcctgcaacggcgcgagcaacgcgcgctgcggctcctgccccgtgcagagcacgatcgtgtcggcttcgatcagctcgtgatcggtgcgctgctcgccgtacgacacgtgcagcccgcgcgcatcgatcaattcgtagttcacgccgccgatcatcttcacctgcttcatcttcagcgtcgcgcggtgaatccagccggtcgtcttgccgagccccttgccgagcggcgcggccttgcgctgcagcagcgtcacttcacgcgccggcgccgtgacctgcgcacgcgtcacgccgccacgcgtcgcggccgggtcggtcacgccccactcggccttccattcttccagatcgagcgccggcgattcgccgtcctgcaccagatattcggcgacatcgaagccgattccgcccgcgcccaccaccgcgacccgccggccgaccggctgcctgcccgcgagcacatcgatatagctgagcacgttcggcccgtcctgccccggaatcttcgggtcgcggggcgcgacgcccgttgcgagcacgatttcgtcgtagccgcccgcgatcaggtcgctcgcgtcgacgcggcggttcaggtgcaggttcacgccggtcagctcgacctggcggccgaagtagctcagcgcttcgtgaaactcctccttgcccggaatccgcttggccatgttgaactggccgccgatctcggccgcgccgtcgaacaggtcgacccgatggccgcgctgcgcgagcacggtcgagcacgcgagcccggccggccccgcgcccaccaccgcgatgcgcttcggctgcggcgcgggcgtgtatttcagctccgtctcgtggcatgcacgcggattcagcaggcacgacgcgatcttgttcttgaacgcgtgatcgagacacgcctggttgcagccgatacaagtgttgatctcgtcggcacggccctgtgcggccttgatcacgaactcggcatccgcgagcagcgggcgcgccatcgacaccatgtccgcgcagccgtccgcgaggatctgctcggccacttcggggcgattgatccggttggtggtcacgagcggaatgccgacctcgcccttcatcttcttcgtcacccacgcgaacgcgccgcgcggcaccgacgtcgcgatcgtcggcacgcgtgcctcgtgccagccgatccccgtgttgatgatcgtcgcgcccgcgcgctcgacggccttcgcgagctgcacggtttcgctccagtcgctgccgtccggaatcaggtcgagcatcgacagccggtagatcaggatgaaatcgcggccgaccgcttcgcgtgtgcgttcgatgatctcgatcggcagccggatgcggttctcgtacgacccgccccactggtcggtgcgcttgttcgtatgcatcgagatgaactggttgatcaggtagccttcggagcccatgatctcgacgccgtcgtaaccggcttcacgcgcgagcttcgcgcaacggacgaacgcgcggatctgccgctcgaccccgcgcgcgctcagttcgtgcggcgcgaacggcgaaatcggcgacttgatcttcgacggcgcgaccgcgaacgggtgataaccgtagcggcccgtatggaggatctgcagcgcgatcttgccgtcctccgcatgcacggcgccggtgatctcgcgatggcgccgcgcggcggccgacgtcatcagcgtgccgccgaacggcttggtccagccggccacgttcggcgcgaagccgcccgtcacgatcaggcccacgccgccgcgcgcgttcggcgaaatattcggcgagccgcggcagcgtcttgcggctgtcctcgaggcccgtgtgcatcgagcccatcaagacgcggttcttcagcgtcgtgaagccgagatcgagcggcgcgagcaggtggggaaagggtgtcgtcatgatgatcgtgccagtaagcgatgcgtgacatcgtaggcgcgcgccgccttgaacgtgagggcaaacagccataatgcttgtcatttccggccaaaacgacatgacttctcctctcgccaaggatcgcctcgggctgcgccggccgacgattccggtcgcctacacgcgcctgctgcgcaggcgctggccgcgcgcggtgtcgacctggccgccgtgcgcgccggcacgggcctgcgcgatgcggtgctggccgaaccggacgcgcgcgtcgcgccgtcgcaatgggggcggctcgtgctcaatgcgatcgagatcggcggcgatccgggcatcgggctcgcgttcgggctgctgctgaagccgaccgtgcacggctttctcggctacgcgaccctgaccgcgcgggacatccgcgaggcgctatccgtcacgcagcgctacttccggatgcgcaaccgccaatatcgcctgacctatgaagaagacgaacgcggcgcgacgctcgaactgcacggcgtgcaggcgagccccgtgctgcagcatcacgtgatgttcgaattcgtgctgaccgggctcgcgcagaacatctcgcaatgggccgggcgcgcgtcgccgccgatcgcgctgcaattcacgtggccggagccaccctatttcgcacgctatcgcgaccagttgccgccggtcgaattcggctgcgcggccaacgcgctgtggatcgcgcgcgacgtgctcgactggccgctgccgctcgccgacgaagtcgcgcatcggcaggcgctcgtgcaggtggagcgtgagtatgcgcaggtgcgccaggaggaaggcgatctggtcgaacgcgtgcgtgcggagctggcacgcggggccggcgattacccggggccggagacgctcgccgatgcgctgctcgtgtcgacacgcacgctgcggcgccggctcgaggaagccgggtcgagctatcggcagttgctcaacgaagcgcggtttcgcgacgcgaagcagttgctcgccgcgtcggatctcgacctgaagacgatcgccgagcggctgcaattcaccgacccggcgaatttcacgcgcgcgttccggcgctgggccgggcagacgccgagcgcctatcgggaggcggcttcgggcacggcacgcgactgatgcaaggccgcgaccggcacgaggtgccggcccgcgatttcatcggtatgatcaatcccacgcccaagcggcgccgaccggcgcactctcccgccccatgcccaatcacaccacgctgatcgagtcgacgatcgaccgtatcgatacgaacctcgtccggatcgcggccgacatcaggaaggcgccgctttatcgcctgacgatgcagaacgcctgctacttcatcgccgccgacgatttcgacgcagaggcgttcaagcagatcgatcgattgaagcccgggatggccgtgcgcgcgtgcatcttcgacgatcgcggccgtcaccggatcgcgtggatcagaagcagcgacctggcgatcgcgccttacgatgcgctcggacaaagggacggcaacctgacgctgctcacatgggcgtcgatcgtcttcgtgctgagcctgctgatcggcgccgccgtgttcagatcgggctgggcgttcgtcggcgccctggccttgctcgcgagcatcatcagcctgctgggcatcctgctcgcgatcgcggggctgtccgatctggtgttccggcctcagcgtcgcgaggcgcaggaaaagtggcggtacgaacccgccgggttcacgatggaacggagcaacggatgaccggtcgcaccatgcaaatcgcatccggccgcgtgacgtccgtcagccagaagacgatcactacgcaggtctggagcaacaatctcggctggacgacgcaaggcatcgaggagatcgcgctgcagctcgacacgttcgacgcgccgctcacgctcgtgaccagcgccacgcgcagcctgttcctcgtcgcgggcgatcggctggaggtggcgtacgccgaaggcccggatcgcccggccatctacggcatccacaacgcgaccgacgcctcggtgtatctggttcgacccgcgaaagtcgccgcggcccgcatcgatgtgttcgcgacgctattcctgctggtcgcctccgtcttcattctcggcatcatgtccgcggtgtcgcgcagcctcgacgggatgctcgacacgttcgcgtggttcgccgggggcgcgatcgggttcttcctgctgagcacgatcctgcgcaccgtgttcggcgtgatcgtgtggcccgagatccggcggctcaggcagcccggcggcaagcgcgagatgaacgccgcaaggcaggcgctgtcgatcgcgaacgacgatacgccgaacatccgttttctctgacgcgatacgcacgcgacacgtcagcagccgacgacgatccgcgccccaccgtcaccctcgcccgcctcgatccgcacctcgccagtcgcggcgacgatcgcgtcgtacacgtcatcggtcacgcacaccaccggcaccgcgatcgcatacagctcggccgccacgatcgcgccgatcgagatgatcaggtcgcgctccttcagcacgatcccgaccggccccgtgccgttgcgcacggcttccgcgagcacgctgctgctcgaactcgagcccttcgcgtgcggcatcaccatcaccttgccggcgaggctcgcaccggcctgcggatgcccgcgatcgacgatctttcccgcgcccgaatcgtagccgccccagaaactgagcggcttgtcgagcacgaacgcgcgcgcacatgcgctgcccggcacgagcgtgtcgcccgtcaagcccttgcccgtcgtttcagtcatcgaatcgcacctttccttcgaacgccgaccgcacgcattcgcgcatgctgccgtacgcgaccgtcacgccgatgttcgcgggcgcatacgacgcccatttcccgaattggtcatcaccagccctgacagttgcttcatcaccggcgtgatgtacgtgcaggtgtcgacgacgatctgaatgccgcgcgcggcgaatttttccgcgaggccggcttcctccagctcccacaagatgaagcggctcgtgttcacgtagaaatcgcaggccggcttgccgtcgaacgcgtcgagcaaggtgccgagcgtgcggaattcggccagcgagaaatgcggtgtgccgagtgccaccgcgacgagtgcgtcgccggccgcgccgtggttcagcgtgcggcgaatctcgtcgaggtcggccatcgcaacgtcgaccgtgcgttgcgccgcctgcccgtgcaacgcggcgtcgagcgtcggcgcctcgggtgtgatgcccaccgcatggaacagtgcgacggcgccgctcgatgcggccgccgcgcccagcgccttgagttcgtcttcggtggtatccgccggcagcccgacgatcgcgggcacaatcgcgcccgcgatcctgccgatcagcagaccgagcgcggcgaaataaatgtcgcgcgacggcaggcggttgaagtccggcgcgttgaacacgatccgcgcggcgcggttcgcttcgacgtgcagccccgcatacggcgcgcgcccggtgatcgcggcagccaggtcgagaaaatcgccataccggctcgtgcgcgcgccgagcaccgagttcgcgaacacgatcgcgttcgattcggcccacgcgatctgctcgcctttcgcgggacggttcttcagttgatacggcgcgcacgtgaagctcgattcgcagccgagttgcagatgcgcgtccatcaggcgctgcgcgtcgcgctgtatcgtgcggtcgccgtggtacagctcgggatggatcaggtcgagcgacccgacgttcagcgtggtcggcaccgcgaccttcgcgccggtgtcgacgaaatattcgacgaagtcgaggctcgtctggccgtggtacaggcagccgtcgatatgcgcggacgtgatgtcgatcaggtgcggcgcggacatcacctgcgccgtgcgtgcgacgatccgcatcgcgcgcgcgacgccatcgccgtaatccccgcgcagcatggcgctgtcgcggtcactcaactgcagcatcggttgctcctctgacgcgtgccgacggcgccggcccgtgaaatccgtcaggggactctacaactggaaataaaaactgtccagatccgcgccgatccggacagtttaaaaaccaatttaagccatatagcgtcaccgaagtgggcaatggctcgaattccgctccagtttgccgccggttcgtctagcgttccgcggtcacgctgaacagctcgtcgcgcagcgccttcgcgcggtcgcgtccgaactgcgtctcgaattcgtcctgcgcggcctgccacgcaaccagcgcccgcgcgaacgtgcgctcgcccggcttcgtgaggctcaacgcatgcgcacgcgcatcgtgctcggacgcggccgtcgcgacgaagccgtcgcgctgcagcggcttcagcgcgcgcagcagcgtcgtgcggtccatcacgaggctatcggcgagttcgctcatcagcaggccgggcctgcgcgtcaggttcgacatgatcgagaactgggcgggcgtgacgccaaccggggccagatggcgttcgtacagttgcgtgacgaagcgcgccgcctgacgcagcgcgagacagttgcacgcctgggcaatcgaggtgtcgttcatgcctcgcaatttatatgtgcatatgcataaagtcaatgtacactccgccgtaaccaggccggcggccggccctcgcgtcaaggagacggacatggactacatcgacaagctgaggatcttccggtcggtggtggagctgcgcagcttcacgcgcgcagccgacatgctcggcctcgcccggcccgtcgtgtcgcgcgcggtcgcggatctcgaagcgcgcttcggcagccggctgctgcaccggaccacgcgccaggtgtcgctgaccgaaaccgccgagcgcatctatgagcgctgcgcggccgtgctggacgagctcgactcgctcgaagcggaagcgcagtcgccgacgcgcgagcccgaaggcctgttgcggctcgtcgcgcacacgacggccgcgctgaaccggctggtgccgctgatcgccggcttcaaggccgcgcacccgaaggtgcgcctcgacgtgacgctgaccgagcgcccggtcgatctcgtcggcgaaggctacgacatcggcatcgtcgtgccgtacatgctgacgagcgaaacgaccgtcgtgcggctggtcgaacgcattccggtcgtgatcgtcgcgacacccgcatacctgcgcgcgcattcgcatccccaaacaccggccgatctggccgaccacccgttcgtgccgatgtcgccgtcgctgcggcggcccgccttgtcgttccgcatcgacggcgacacgctgaccgtgccgttccgcttcgacatctcgtcgaacagccccgtcttcaaccgcgaaatggtgatgcacgacttcggcatcggcgtcgtgccgaaaacgctcgtcgggaacgaactcgcgtcgggcgcgctcgtgcagctgctgccggacgccgatctcgtcgatgccttcgtcgagatcaagctcgcgtacgcgaaccgcgcgctgctgcccgcgaaggtcaaggcgttcatcgactacacggccgcctattgcgaccgcgaaggctggatcgttccggcggccgcctgacgccgattggtacagccgtgacaacaatctgatcccgcgcctccgctcgcttcatgccgtattgctacctaacatgtgcacatgcacaagacaacgctcaccgatgacgattgcttcgcggtccggcaagccgctcggcgaatctcgcagttctacgagcgctatctgtcgcgcgcgggcgtcacgccatcgcaatacagcattctcgcgctgctgcgcgaccagcccggcctgacgatggcgaccttgtcgagcgtgctggtgatcgaacgcaccgcgctgctgcgcgcgctcgccgctcgtcggcgcggcgctggtggcgggccggatcgagccgccgtgccgcggccagacgttcgcactcaccgagcacggcgaaaccaaggtcgcagatgcgcacgtgcactggctcgccgcgcaggaagcattcgagcggtgtttcgggtcggcgcaggcggcccgcctcagagacgaattgttccggatcacgcacaacctgccggaacgctgattgacgacttccccgacggacggcacgccgtctttcgttttgatacgtgcatatacataggtgaatcgatggaaacgacccaagccgctgccgcgtcacgcgaagcagccacaaccgaccaacccgcgaagcaacagcgccgcgtgccgtggatgcgcatcgcggtgggcgccgtcatcgtcgtcgtggccgccgccgcgctcgactggctgttcgtgctgcgcttccaggaaagcaccgacgatgcctatgtcggcggcgacgtaacggtgctcgcgccgaaggtcaacggcttcgtcgacaagatcctcgtgaccgacaaccagcgcgtgaaggccggcgacgtgctcgtgcagctcgatgcacgcgactacgacgcgaagctcgcacaggccagcgccgaagtcgacagcgcgcgctccgccgtgaccgaactcgaggcgaagcagcaactgcaatatgcggtgatcggacagcacgcagcggacaagaacgcttcgtcggccgagctgacgcgcgccgcatcggatcgagtgcgctaccgcgagctcgtgaaatccgacgcggtgtcgaaccagatcgtcgaacgcgcggacgccgattactcgaaggccggcgccgccgtcgaacgcagcgacgccgcgctgctcgcgtcgaagcggcagctcgacgtgctcggcgcgcagctcgccgacgcgcgggcgcgcgtgaacaccgcgctcgccgcgcagcgcgtcgccgcgctcaacgtcgaatacacgacgatccgctcgccggtcgacggttacgtcggcaatcgcacgggccgcgtcgggatgctcgcgaacgtcggcgtgccgctgctgacgatcgtgccggcttccggactgtggatcgacgcgaacttcaaggaagaccagcttcgcaagatgcacgcgggcgatcgcgtcgacgtgtcgctcgatgcgtcgagcacgcgcctgcacggccgcgtcgacagcctcgcgcccgcgaccggcgcgaccttcagcgtgctgccgcccgagaacgcgaccggcaacttcacgaagatcgtccagcgcgtgcccgtgcgcgtgcatctcgatccgcagccgggcctcgagcacgtgctgcgccccggcctgtccgcggtcgtgaccgtgcataccggccgcgcgaactgaacgggagacgacgatgaccaccgcgttttccggcgacccggcgtcgcaaccgacgaagcagcgcgtcttcgccttcgcgctgatgtgcgtcggcttcttcatggcgacgctcgacatccagatcgtcgcgtcgtcgctgcgcgacatcggcggcggcctgtccgccagccaggacgaactgtcgtgggtgcagacggcctacctgatcgccgagatcatcgtgatcccgatgtcgggctggctgtcgaaggtgatgtcgacacgctggctgttcgtcgcgtcggccgtcggcttcacgatcacgagcatgctgtgcggactcgcgtgggacatcaactcgatgatcctgtttcgcgggctgcagggcgcgctcggcgccgcgatgatcccgaccgtgttcaccaccgcgttcgtgctgttcccgggccggcagcggctgatcgcgtcgacgaccatcggcgcgctcgcgtcgctcgccccggccatcggccccgtgatcggcggctggatcaccgatcaatggtcgtggcactggctgttctacctgaacctcgtaccgggcatcgcggtggccgcactcgtgccgcgctacgtacatatcgacgaacccgacctgagcctcatcaagcgcggcgactacctcggcatcgtgctgatgtcgggtttcctcggctgcctcgaatacgtgctggaggaaggcccgcgcaagaactggttcggcgacgatgcgatcgtgatctgcgcgtggatctccggcatctgcggcttcctgttcctcgtgcatgcgctgaccgccaaagatccgatcgtcgacctgcgcgcgctcgccgtgcgcaacttcgggatcggcagcctgctgtcgttcgtgaccggcatcgggatcttcgtgaccgtgttcctgacgccgctgtttctcgcgcaggtgcgcgcattcagctcgctgcagatcggcatcgcgctgctgtcggtcggtgcgttccagttgatcgcgctctgcgcgtatgcgttcgccgcgcgcttcttcagcctgcgtgcgctgctcgtgttcgggctgatctgtttcggcctcggctgctacctgtacacgccgatcacgcacgactggggctggcgcgaattgctgctgccgcaggcgctgcgcggcatcggccagcagttcagcgtgccgccgatcgtcacgatggcgctcggctcgctgccgcagtcgcggctgaaatcggcgagcggcctgttcaacctgatgcgcaatcttggcggggcgatcggcatcgcggtgagcgcgacgatgctcaacgaccggctgaattttcactacctgcggctgaacgagcacgtgagcgccggcgagccgcagatcgcgtcgctgctcgatcgacaggccgcgtactggggctccgtcgcaggcaatacgctgaataccgcgcaggccgggctcgcgaacctgcatcggctgatctatcgcgaggcgctgacgctcacttatgcggatgcgtattacgtgctgtcgctgtgtttcgtcgtcgcgctgtttgccgtcgtgttttccaaacccattacgttgaacgcgccgccgccggacgcgcactgaggccagggtcatcatcatgaaaaagctactcgtcgcgctggctgtcagcgcattcgccgccgggtgcgcggtgcagcccgcgcagcatccggcgctgtccgaatccgtccagacgctcgcacccgccgcatgggataccgacgtgccgcgcgcggacatcgacgccgccgcctggtgggcacaattccacgatcccgtgctcgaccggctgatcgcggtcgtgctcgacggcaacctcgatctgcaggccgccgccgaacgcgtgaagcaggcgcaggcgctgaccgtgcagaagcgcgcggtgctgctgcccgaactcgacgcgaccgcgcacgcggccgacgcacgccagaacacgccaccgccgctcggctatgtgcggcaggccggcgcggggctcgcactgagctggtcgcccgacgtgttcggcggcgaacggctcgacctgctcgccgcgcaggcggaactcgtcggccagaagcatgcggaagatgcgatgcggctcgcgctcgcagcggatgcggcgtccgcgtatgtcgatctgcgctgggcacagcaggaactgaagatccttcaggacaacgcgaagatccggcagcatgcgctcgaactcacgcgcaagcgacaggcgttcgggctgtcgacggaactcgacgtcacgcgtgcgcagaaccagctcgacgcgctcgaagcgcggattccgccgacgcaggcgcagatctcgcatcagctcaacctgattgccgtgtattcggggcgcacgcctgaatcggtcgatcggctcgtgctcgcgcaggccggcgacattcccgcaccgccggccggcgcgcccggtacgttgccttcgcaggcgctgctgcggcggcccgatgtgctgactgcgtatgcgcaggtcgagcggcgggcggcgcaagtcggcgtggcgaaggccgagcggtatccgaagttttcgttgaacctgacggacgggattctcgcggcttcctatctcgggttgccgacgttgaccgacaacctgttcagcgcggcgttgagcgcgacgagcccgatcttcaatgcggggcggattacggccgatatctcgcagagcgaaagccggatgcgcgaatcggaactcgggttgcggcagacgatgctgcaggcgttgcgggaagtcgaggatgcacgcgcgaatctcgtcagcgccgatgaggcgacgcggcggctcgatagtgcgctcgctgcgtcggacaaggcgctcgggctggcgaatcagctctacaagggtggcgcgacggattttctggatgtgctgtcggcgcaggaggtgtatctgcgggattcggattcgctcaaccaggtcaggcgcgagcatgcgctggcggcggtcgcgctttatcggtcgcttgggggcgggtggagcaggaacgacgcgacgggtgggccgacggtggaggcggtggcgaagaactgaacgtgatcacgatacggcgccggcttcaacacttgccggcgtcccgctcgtcaaccgcacgaccccagacatttgaccgacgacaacgcgatcaggtaaaccgccagccacgcaatgcccagccccgcgatgacggtgacgatacgcgtgatgagcttgtgccagaaccggatcgcagcgaacactcccgccgccagcaggagcccgatgaggatcgggccgagcacgttcatcgcagcgttaccgatccagcgccagcttcgcgccgagccccaacaggatcgtccccatcaccgcatcgatcggcttgcgcagtttcgcgtaacccgtctgcacgcggttcgtcgagaacagcacggccaccgtgcagaaccatgtcagcgatacggcgacgaccacggccagcgtcgcgccatgcacccatgccggcgcatgcgcgggcagcagcgtgacgaacaggctgccgaagaacgccgcggccttcgggttggtcaggccgaccagcagccctttccggtatgcatgcacgccgccgcgaacgatcagctggcttgccgcttcagcctgccgtgccgactggcgcaggcccgacagcgtcctgatgcccaggtaaatcaggtaagccgcaccggcgatgcggatcgcctcgtacagccacgcgagcttcgcgacgatcagcccgagcccgaaaatcgccatcgccgcccacacggcatgcgacgacgcaatgcccgacgcggccagcaaacccgcacggcgattgccgagcgcatgggacgaaacagcgatcaggtcggggccggggctgacgcacgccagcaacatcacgccgccgactgcggcgagttggggaagatagctcatggcggttcgggaggattcaggtgaggaggaatgccggcttactctagcacgccgattctggttgcatgcgggacgatctggaacggggtgcgccggcagccgcatactttccctcgtgccgccgccgcgggccttgcaaccgcgtattacaggggcgggcgcgtcggcgggctccgcgtggatcgatgcagcgtgtgcgacagattcgccgccgcttgaaaggcgatgttcgacgttttgtctgcgctgcggcggatggtcagacggcgtcgggccagcggtagccgatcacttcgttcaacgggtacgcaagttcgcgcacctcttccagttgattgccgccgaacagatgtacgtgctcgtcgtcgtgacgcaggtagaaaccgacatgccctttccagctcgcgggatcgtcgcgcgtcaggatcgcgatgcagccgtacacagggcgctccagcggccggccccattcgagccacgaacgcgcgagcgcggagcccgtcccgcgaatgccggcgtgcgtcatgcaccagttgacgaacgacgagcaccaggaaatcttgtcgtcgtagccgaccaggttcgtctggttgttgtattcgacgatgcgcggattgatgctgccgggcggatggcggcggatgccgagttccgccatcgcgacggacatccagggcgggtgggcggtgtccggtttgctctcagggttgaatgcggtcacgtcgttctcgagcgagtgtgatgtgcggtcaatcttcgcacgaatgatgcgaggcgacgagcacctgtacgcgtggcctcgcgttgtacgagcgcgttcaagtgcctgacgaccatgctcggcgacaggccagcttcggaaccgggagagcgtggtgcgccgatcgaatcgaagcgtaacgaatcgatcgcgcgcgagggttggacgcgcgttgtcgtgcgcgcccgggtgactcatctgcgttgggtgtcgggtaccgcggcgttacctttaaccgcgtgtgtcgatccagcgacgtgcccagcgggccgagtgccgcagtgcctgcgcttcgctcgcgaagtagtcgagcgaatagaactggtagcggccttccgcgggtgtgctgtcggtacgttcgagcaccaggttggatgaaaaactaccgtcgggcaaacgatgcgccgagggttggacggcatagccgttgtattgttgaattcgtttgttttgcatttttaattttaatcatgttcgagtgcgcgcatgccgtgcgcaatatgcacggacgcgtcgattcaaagctattgcaagctgaatctgaagctttcggaaaacgaaagtgaggcgttgctgccggaggggaatgaagtgcaacgaggcgtgtggcgcttggcgagctgctgaatgaacagatgcagctaagagcaatcgcgccaacttcaggagacgaagctccgtggggtgtcgctgcgacccggcgtccgtcgtgggaggccgggcccttcaaactttacagcggcgtgatgttggccgcttgcagacccttcgggccctgcttcgtttcgaagctcactttctgattttcagccagcgtcttgaagccgtcggcacgaatttcggagaagtgggcgaacaggtcgtcaccgccgttatccggcgtgatgaagccaaaacccttgctgtcgttgaaccacttgacgataccggtatccatgaagattccttgagaaaaaatagagagatttgcgccgttgaagagcgcgtgaagcgtcaaggaggagaggacaacgaataccgctgtggaaagcgagcaattgatgaacagcaatcggacttcttggacttcgatgcgtacactaaccgccgggctggcgcgcgtcaactgctaacttgtaactgttttaccgcgcgatccgcttttcgggcgaatcgatgtggccccaaccggctgcgcgccttacccggccgggcgcgcgttgcgcacaatctccggacgaatacgctgatcggcaacgcccttctctccttgtgatttccgttcgctcagtccgtatcatgtcggcagcccctccgactacccgcctgccatgcgcatcacgcctcttccgcctctacagtgcctggtcgcgttcgaagccgccgtgcgacatgcgagcttcacgaaagccgccgccgaactgcacctgacccaaagcgcgatcagccgtcagattcaacaactggaagaattcctcggccgctcgctgttcgtccgcgagcatcgctcgctgcggctgacgatcgccggcgagcaatacgcggcgcaggtccaccatctgctcacccaatgcgcggaagccacgcacgacgtgatgaaaccgtacggcgatctcgagctgacgatcgcgtgctcgtccggcgttgcggtgctttggctgacgccgcggctgccagactttcgcgccgcgtatccgaacgtcaagctgcgcctgatcgtgcgcgacggccttgcgtcgatgtcgccggcggaattcgacgtcggcgtctactacgtgcgccagcaggcaccggccgaatacaccgcgcgcaagctcttcgacgaggaagtgtttcccgtctgcgcgccgggttatctggccggccgcacgctgaacgcggccgacctcgcgaacgaaacgctgctgcgcctcgaagacgggcagcgtcaatggatgtcgtggtccgaatggttcgacatgaacgacgtcgaccggcaaaggcgcagccgcaggacatcacaatcaattcgtatccgcagatcgtgcagatgacgatactcagccagggcgtgtcgctcggctggcgctacatgatcgacgcatgcatcgaagccgggctgctcgtgcgcgtgacggacgcgtccgcaagccacggcggcggctattacgtgatctcgcccaacgaccgcgcgcagaaccacgccgcccgcctgttcacgcgttggctgttcgaacaggcggagaagcagaccgcgtcctgagcgcaatgcatgcgtacagcgcatgcgtgcatgcgaatctttcgtttcagaaaaatccggctgtccttagcatgagattcacgcggggcagccgtcccggcttctgacaaaggaagagaccatgcaaggaacgctttccccgcgcgccgcgcctgccgttgatgcggccgtgcagcaacgccgccgcgccatcgtcgcgaccgtgatcggcaacggcctcgaatggttcgacttcaccgtctacagcttcttcgcggtgatcatcgcgaagctgttcttcccgaccggcaacgaactgacgtccgtgctgctgaccgtcgcgacgttcggcgtcggcttcttcatgcggccggtgggcggaatcgtgctcggcgtgtatgcggacaaggtcggacgcaaggccgcgctgtcgctcacgatcctgctgatggcggccggcaccgcgctcatcgggatcgcgccgacctacgaacaggccggcatcgccgcgccgatcctgatcgtcgtcgcgcggctgctgcaaggtttctcggccggcggcgagatgggcggtgccaccgcgttcctcaccgaatacgcgccgccggagaagcgcgcgtattactccagctggatccagtcgagcatcggctttgcggtgctgctcggcgcggcgaccggcacgttcgttaccacgtcgcttgatacgcaggcgctgcacagctggggctggcggctgccgttcctgctcgggatcatcgtcgggccggtcggttacttcatccgcagtcatatcgacgagacgcccgcgttcagcgccgtcgaatcgcaggcgaaggaaagctcgccgctgaaggaggtgctgtcgacctacccgcgcgaaaccttcgcgagtttttcgatggtcattctgtggacggtctgtacctacgtgctgctgttctacatgccgacgtattccgtgcgcacgctgcatctgccgcaatcgaccggcttcgcggccggcatggtcggcggactgatgatcatgtgctgctcgccgatcgtcggtcggctcgccgacgcgtggggacggcgcgtgttcctgtccggctcagcgctcgcgatcctcgtgctggcgtggccgatgttcgcgtggatcaaccatgcgcccgggttcacgtcgctgatcgtgttccaggccgtgttcggcgtactgattgcgacttataccgggccgatcctcgctgcgttcgcggagctgttcccgaccaaggtgctgtcgaccgggctttccgtcgcgtacaacttcgcggtgacgatcttcggcgggttcgcgccgttcctgatcacatggctgatcgcccgcaccggcagcaacatggcgcccgcgttctacgtgatgctcgcggcggccgtcagtttcgtcggcacgcgcttcgtgaaggatgcgaagcgtgcggcctcaacgactcgataaggacatttctcccatgaccattaccgtgcttcaaggcggcaacgtgctcgacctcgaacgaggcgtgttgctcgaacatcatcatgtcgtgatcgaaggcgagcggatcgtcgaagtcaccgatcggccggtggattttccgaatgcgcaggtgatcgacgtgcgcggcaagaccgtgatgccgggattcatcgattgccatgtgcatgtgctggcttcgaacgcaaaccttggcgcgaatgcgacgcagccgaatattctcgcggcgatccggtcgctgccgattctcgatgcgatgttgtcgcgtgggtttaccagcgtgcgggatgcgggggcgcggattggagtttgatgcaggcggtcgagacgggactgattccggggccgcggatttttccgtcggggaaggcgttgtcgcaaaccggcggacatggggattttcgtcctcggggagatttgctggagccctgctcttgctgtttcaggacgggggcgattgcgcgggttgtcgatggggtcgaaggggtacggctcgccgtgcgtgaggagattcagaaaggcgcgacgcagatcaagatcatggcgtcaggtggcgtggcttcgccgactgatccgattgcgaacacgcagtattcggaggatgagattcgagccatcgtcgatgaggctgaggctgcgaatacctacgtgatggcgcacgcatatacggggcgggcgattgcgcgggcggtgcgatgcggtgtgcggacgatcgagcatgggaatctcgtggatgaagcggccgcgaagatcatgcacgagcatggggcgtttgtggtgcctacgctcgtgacttatgacgcgctggccaagcatggcgcggagttcgggatgcccgccgactccgtcgcgaaggtggcttccgtgcagcagaaaggacgtgagtcgcttgagatctatgcgaaggccggcgtgaagatggggttcgggtcggatctgctcggcgagatgcacgcgtttcagtccggtgagttccggattcgggcggaggtgcttgggaatctggaagcgctcaggtcagcgactacggtggcggcggagatcgtgaatatgccggggcagcttggggtggtggccgtgggtgcgatcgccgacctcgccgtgctcgatgggaatccgctcgaggatatcggggttgtggccgatgagggagcacgggtcgagtatgtattgcagcggggaacgatcgtgaagcggcgtgacagcgggcgttgatgtggcgccgtgcggctatttcggcaagcgcagtgcagcctcgcgggccgtgcgaccgtgacagttcttgaaggtggcagtgggtgtgaggcgcggcgttcgcggcttggcttcgcccttctcgtagcccaagtggtggatcggttcaccgcccagcgcgctcgaagatcgccttcttgagcgccgcgagccgctcgttgatcgtcgcccgatccagcgttccgggcaccagttgcttgatcagttccgagtccaggttcaagcctttgcccggctcaacccacggcagccgtccctcagaaacgctccattccaaaacgcgaatcagcctttattcatccaccttgaaagccgacacgagcctcgtcagttccgccgcctgctgtttcaagctcgccgccgccgctgcgctttcctcgaccaaagccgcattctgctgcgtcatctgatccaaagactgcaccgcatcgccgatctgatcgatcccggcgctctgctccaggctggcttcggcgatctcgctcatcatcgcgctcacgccctgcacctgcgacacgacatcgctcatcaccttccccgcctcgctgaccagccgcgatccggtattcaccgtgcccgcgctatgctcgatcagcgccttgatctccttggccgcctgcgcgctgcgctgcgccagattccgcacttccgaagccaccaccgcaaacccgcgcccctgctccccggcccgcgccgcctcgacggccgcattcagcgcgagaatgttcgtctggaacgagatgctgtcgatcatcacgatgatctcggagatccgctgcgacgcgtcgctgatctgctccatcgtcgtcacgacctcacccaccacctgcccgccgcgcgccgccgtatccgacgcgccgttgatcatcttcgctgccgtcgtggccgtctcggtgttgttgcgcaccacggccgtgatctcttccatcgacgaagccgtccgctccaggttgctcgactgcccttcggtacgttcgctcagatcagcattccccgacgcaatctgcgccgaacccgtggcaatcgacgcggacgccgcgcgaatgctgtgcaccagcgtcgacagcgacgacacgaaccggttgaacgcatccgacaactgcccgatttcgtcctggctctcgaccgtcatccggcgcgtgaggtcgccctggccgctggcgatctccgacagcagcgtcgccgcgcggcggatcggcgcggcaatcgcgcggcccaccagccagatcacgagcagcgcaaccgcgaggcccaccaccgccgcgaccagcgccgcgctgcggatcgcgcgcgtcaccggcccgagcagttcggcctgcggcacctcgacgacgacatacgcgttcagttccggaatgaacgacgtcgcgatgaagcgcgcgccgccgtcgccgtcgtagctcaggtacgcatacggcttgccggccagcagcgtcgacgacgcatcgccgggcaacccctgctggtccttcatgaaatgcttgccgtcgatcagcgacgaatcgcgatgcatcatgatcgcgccgtcgggacgcacgagatacgcgaacccggtctcgccgatccggtaggcggcgatccccttcgcgagcgcatcgacggacaggctcatgctggccgcgccgatcggcacgccgtcgagctcgacgcggctgttgatgaacatcatgtagccgccgaccgtcacctcgcggtccatgttcacgtcgaacgccttgccggacgacaggaagccggtcagccactgatccttgtcggtcaccttccgttgcaggccggattcgttgtagtagttgccgctcttcacggacacccactgcaccgacgcggccttctgctcgtccttcacgttcttcgcgagctggatccagttgcgcgtgccggcgtcgggttcgccgtcggcttcccattgcagcaggaacgcgtcgcgcgcgagaatccgcgacgcggcgatcggcccggccatctgccgctgcacgtcggcgcggatgccgttcacggccgtcggcagctcctcgcggacgacgcgatcgcgcaccgcgttgccgatcagacggatgctgagtccgctcgagatcgcgacgaacacgagcaggcaactcgtcatgctgagaatcagcttgttctgaatggaaagcttgcgccagaagtgcatggggaaccctcggtaaccgctcggtctgagccagtttgggttatcggcacgcacgcgcggaaccgcatcgcggatttcagatgttcatcatgcgagattcgttatgttgttatcaggcgggcatagccggccacctgtcgactcgcgatcagcgcaaatcagtatgcgacgaagatcgtgacgcgccggtttcgcgcccgcgaagccgcatcgtcgcccgccacgagcggctgcgtatcggcccgcccgatcgccgccaggcgatgcggcgctacgccgcgttcggtcaggtagcgcacgacgctcccgcacgcgccgacgacagctcccagttcgattcgtatttcgcgtttgcgatcggctggctgtcggtatgcccttcgacgaggatgtctccggtcgcgtgctcgctcagcgcctgcgcaatctggttcagcaccggcgacgaatcaggcagcaagcgcgcatcgccgacgttgaacaggatcttcgcgtcgatgccgatctcgacaccatgcggcgccttcaccagcgaaatccggccgttcgacttcaacgaatcgagcaacgcgagccacggcggcgcatggtcgggcgtagccgcatcggccgcactcgcggcaccgccagcctgccgcgcaagcgtctggtaccgcgcgtcgagcgcgttgtatttcgcgagctggagcacgtacaacgcgagaaacagcaccatcagcgtcgtgatgagatccgcgtacgaaatcagccagcggccggactgcgcgccttcgacttcgtggtcgtcgcgatcggcggcggaggcaccgtcagttcgagcagtcatgcgattggaaatcccggttggtcgtccgacacacgctcgtcacgcaagcgattccgccgcgcgtccgcgcacgtcgccggccaggcgcgtttcgatcgtatgcggcgattccttgcgcgatatcgccaggaaaccgtcgagatacagcttgcgaaaccgcagctcgctgtcgatctgcgcacgcagcttgccgtaaagcggcaggaacacgaggttcgcgaacgccagcccgtacagcgtcgcgatgaacgcgaccgcgatgcccggcccgagctgcgccggttcgagcatgtggctcgtcacctgcacgagcccgagcaccgatccgagaatgccgaacgtcggcgcatatccgcccgcctgctgccacacgcgcgcggccgccaggcggctgcgttcgtacgcatcgagttcgcgctgcaacgcgtcctcgagcacggcggtcgatacgccgttcgccagcagttcgagcccgcggcgcgcgaacggatggatgccgctcacgtccatcgattcgaacgcgagcagcccgtcgagcttcgcgcggtcgccccattcgagcaggtcggacaggttcttgcgatcgacctcgcgcgcccgcacgaacgcgagccgcaactgtttcaccgcgtcgaagaagcgtgcccaggtgttctggatcatcaccgcgccgagcgtgccgccgagcacgatgacgagcgcctcgaactggaacagcatcgggaaatgcccgccttcgagcgcgaagccgaacacgatcgccgcgccgcccaacaccacaccggccagggtcaacagatccatgcgcgccccttggtcatgcatccgatgccgatgcgacgggcgcggtgcccgccgccggcgccttcgccgcgcgaacggcatccagcacgcgtcgctcgatgtcctcgatctcgaccggatcgagcttgagctcgcgacgcatcacccacgacacctcgttgcgccgcgcctcggtcatcacggagaacagcttgtcggccaccgcgcgatcgtcgagattcgcgatcagcttcgcgagatcgtaggtgtcgaacgcgctgatgacgtcgaacagcgtgcgctggtcgatccacacgagatcctccagcgcgcgcacgtcgccgccgcgacgcgcgttgcgccgcgagaagtacgcgacacccttctgctcgacgtaactgagcaccttcgatttgcggaacgcgaacacttcgtcggcaatctcgccgttcgacagcttgttgagcagcatcgtcttctcgacgccgatcagcgattcgagatcggcgagctcgatgagctcgagttcgctgttgatcgacaggtcgagatcgtgatcggccacctgttgcgcgcgatcgatcacgcgcgcggcgtcgaacgtgacgacctggcgcgcatccgacgacgccgcataatcggccgccccgccggcatggtccgcctgcgccgcttcgatcgtgacgagattgagcttctccatgcgtcgcagcatcgcgagcacgtgcggccgcgagtggccggcgatcgcgcggcatttgcggatcacttcggcgagcggcaccgacgtttcggccgcatgcgcctgcatcggccggcgcgtccacgcgtcgccggcttcgcgcgcatcggcgcccgccatcagcgccagcacatgcgcatacgacagcacgcccggcatgaagtcggcatgcgtataggtcgcgagctggtcgtccttgcgcttcacgcggcggatcatcgtgcgcacgatatgacgcagcagcgccgacacacgctcgatttcctcgtcgagcatgccggccggtacgaccgtcagctgacagaatgaaagcgccttcgcggtatgggcacgcggctcggccgcgagcaacgccgattcaccgaagaactcgccccgaccgagcgtcgcgacgacgacacgcttgtcgtcgcatcgcgtggacagttcgaccttgccgtcggtgatcagaaagatgacgggctcgcccgcaaaaccctcggaataaatgatttcccgggcgccgccgtacgcgtccacgattgctgacgattcaagtcgattcccctgctgcgctgattgttgcggactgcgcgtcgcacgtcggaagcatgcgatcgcgagtcgtccccgtgactcgtttacgtcatcgcgctcaacatcctttagggcattcgtcctcgcgtcgaaccgaaatcaaggtaaaacgtttgcgcgttacgccgccggatcgaaacgttcgtttcgatgccggtgcgtgtagtgcaattgaaagcgacgtgcgatcccgcgcgtcagaactccatgtcgagttcgtcgatgtcttcgtgctccgccttcgccgcatcgatccactccgtcacgaacggatgcgcgagcacctgcatgcagtactcggcgatatcgggctccagcttcacgtcgtaggtcaggaagcgcgtgacgaccggcgcatacatcgcgtcggcgatcccgatctccgcgccgaacaaccaggggccgccgtacgcagccaggcactcgcgccagatcgtcacgatccgctcgatgtcgtgctgcgcgcgcgaccagatccggaagccggggaaatgcgcgcgcaggttcatcggcaacgcggatcgcaacgcgctgaaaccggaatgcatctcgccgcagatcgaccggcaatgcgcgcgcgctcgccggtcctcgggcagcagccgcgcctgcggccggatctcgttcagatattcggcgatcgcgagcgtgtcccacaccgtgttgccgtcgtgcgtcaggcacggcacgagaatcgacggcgacagcagcagcaactccgcgcgcgacgcggcatcgatcggcacgctgaccgtctcgaacacgagcccgctcagcttcgcgagcagccagccgcgcatcgaccacgacgagtaattgcggctgctgatggtcagcgtcgtctgtccggtgacttccatgtcgctcccctgtccaaaaccgttcgtgcccctgcaccgaaaacggacgccacgcggctcacccgcaccatgccggtgccgcggattcgccgaaccggcgcggcaacgcacgctgtcgcggcgccagaccggcgccgcaacgcatcgcacgcggctgccggttctcgcgtgccgcctgcggcgccgcgcttccgaaccgcgtgcaacgcgcgtgccagccgcgggctggcacatggcttgcctcgttcgatgcaacgcggcacaacgagcaacggtcatgaatctgcttgcctatccgttctatcaatggtctgccgaatgcgtgcgccccgcgcgcgcatgggccgcggccgcccgcgcgacgatgtcgctgtggccgccctccaccgcgacgccgaccggccgcatgctcgacgcgctgtgcgaactgctcgaatgctgcgcgttctcgcaccggcgtccgccgttcggcatcgcgtcggtcgtcgtcgacagcaaaacggtgccgatcgtcgaggaagccgccgcggccaccccgttcggcacgctgctgcatttccgcaaggcgctgccggtcgcgccccagccgcgtgtgctcatcgtcgcgccgatgtccgggcatttcgcgacgctgttgcgcggcaccgtgcatacgatgctggccgaccacgacgtgtacatcaccgactggcacaacccgcgcgacatcccgctgacggccggacggttcggcgtcgacgaatacgtcatgcacgtgatcgacttcatccgccagatcggcccggacgcgcacgtgctcgcggtctgccagccgaccgtcgccgcgctcgcggcggtcgcactgatggccgccggcggcgatccggcgcagcccgcgagcctgacgctgatggcggggccgatcgactgccgcgtgaatccgaccaaggtcaacgcgctcgcgacgagccagccgatcgaatggttcgcgcgaaacctgatcagcgtcgtgccggcgggcttcgtcggcgcgcagcgatgcgtgtatccgggtttcgtgcaggtcggcgcgttcatgtcgatgaatcccgatcgccacgcggcgtcgtttgccgacctgtattacgagcgcgcgaaaggcgacccggcgaaagccgacacgctgcggcacttctacgacgaatacttcgccaccgccgatctcaccgcggagttctatctggaaacggtcgagaaggtgttccagcaatacgcgctcgcgcgcggcgagctgacggtcggcgaccggctcgtcgagccggcggcgattcatcgcaccgcgctgttgacgatcgaaggcgagaaggacgatatctgcgcggtcggccagacggtcgccgcgcaggagctgtgttcgggattgccgtcgtacctgaagacgcaccacgtgcagaccggggcgggccactacggcgtgttcaacggcagccgctgggaaacgcagatctatccgatcgtgcgcgcgacgatccatgacaacgagccgtacgatcgcaccgcgggcgcggaaggcgacgcggacggcacgcactacgtgacgctgcgcgcgctgctcgatgcacgcgcagcggcgcacgacggcgcgaccgatacgaccgccgcggcgtcggatcaggcccgctgaaaccggacggcgctggaaacgaatcgccccgccgaggttggcggggcgtgagtggccgcagcgtgcggacgacgcgcgaggaatcaggctcgcgcgtcggcctgcgttacgaacaggccttgccgtgcgacgcgtggtagcccttcgccttcgcatcggcttccgacatgtagctgccgtgcttcgtcttgccgtaatacttgtcggtcgagcagtgatagaccttcgtgctgtcgttgacccacaccttgcccgggccgccgcccggcgctgccgccgcggtcgtcgcggccgcgctcttcgccggcgcggtgccggatgcagcggcagcggaggccgccgttgccggcgccgcggccggtgcgctcgcggctgccgccgacgaggcgccgtaccaggtcttcacgcccttgtggcccgcgcatgcgcccttcttcgacgcgcccgagtagaacgagccgtccttgcacagaccggtcgtgccggccggcgcgctggccggcacctgcgcgaacgcaccgatcgacaaccccatgccggcgaccagcgcggcgatcaacatcgtttttcatgatcctctcctgatttgcctgactgaagaatgcgttccgggtcgccccggaaaattcgcgcttaccgcacccagcggcacacgcgatggtggtgatgatcgacgtggcacacacgatgcgaatgcgcttcggcaagcgccggaacaagaaccgcacatgccactgcggtagccgtcaggatcttcgcgatgcgcttcatgaaactctcccgggtaggtcaaccggcgatccggctggtacctccttaacgccggtcgtcggcaggccgtgcaccgccaccccgcgcaattgacgatctttgacatcgaggcacggccagcgcgtcgaagctgacgaatgtctttcttttctttccggatcttcagctttccaaccgttcggaattcgaaagaatgttgccggggaagggaaaacgtgccgcaggcgtcatcggtacgcatggaggcttccgggagcgcgcaacaaaaaccgcccgaaggcggtctgatgcaagcgtgcgtgtgatgcgcgcccagggggcaaccgggcagctacgcgccagcctccccacggcgtcggcggcggcacggcgcacggcccgtcgacgtcgatcgacttgaaatcggcgggcccgacgatctccaggtattccatgtcaggcgagtagtcgaacagatagtggacgatccccggcgcctgatgcacgcagtcgccggccgccaccagcgtctcccgttcgccgtacatgaagcgcgcccagcccttcagcatgatcacgatatggaactcggcctcgtgacggtgccagccggtgcccgcctccggtgcatgattcgccctgacgagttgcgcgacgaccttgccgttcgtcgcggtcgcgatgccgagatcgcgatacaggaagaagtcgcgcaggccttcgccgcgatacgcggtgtcctgcggcttcacatgggaaaaagcggtggtggtctgctcgctcatcgcagtgctccttcatcgaaaggatcccgcgtgacaagcatttagcgttccaccctgcaccaccgcccgcctgcttacttcagccgccccgacaggaactgcccgagccgttcgcttttcggattcacgagaatctcctgcggattcccttcctcctcgatctttccctgatgcaggaagatcacgtgattcgacacgttgcgcgcgaagcccatctcgtgcgtgacgacgaccatcgtgcgaccttcctcggcgagcttctgcatcaccttcagcacttcgcccaccagctccggatcgagcgccgacgtcggctcgtcgaacagcatcacttccggctccatcgcgagcgcgcgcgcaatggccacgcgctgctgctggccgcccgacaggtgcgacggatacatgccctcgacgcgcggcgcgaggccgaccttctccaggtacttgcgcgcccgcgcgatcgcctcgtccctgctcaccccgagcacggccatcggcgcttcgatcacgttctcgagcaccgtcatgtgcgcccacaggttgaagtgctggaacaccatcgacagcttggtgcgcatccgctgcaactgcttctggtcggccacccgcagcgagccgttgcggtcgcgcgtggtctcgatcggctcgctgccgatcgtgatctgcccgagcacggctgctcgaggaagttgatgcagcgcaggaacgtgctcttgccggagccgctcgagccgatgatgctgatcacgtcgccggccttcgccttcatcgacacgcccttcaacacctcgttgtcgccgaacttcttgtgcaggttgtcaacggtaagcttgtacatgctgggtccttccttgcgaatcttgcgaatgcgttaatggccgcgcggcgcgaggtacgcgagccagcgcgtctcgagcttgcggaacgcccagatgagcgtgaacacgacgacggcgtacagcacggccgcgatgccgtaggcctggaacgacatgtacgtcgccgaattgacgtcgcgcgtgaccttcaggatgtcgggcacggtcgcggtgaacgcgagcgtcgtcgcgtgcagcatcaggatcacttcgttgctgtagctcggcagcgagcggcgcagcgcggacggcaggatgatccgcgtatagagcttgaagcgcgacatcccgtaggccatgccggcctcgatctcgccggccgacgtcgccttgatcgcgcccgcgaagatctccgtcgcatacgcgcattcgttcagcacgaacgcgagcagcgtgcagttcatcgcgttgcggaagaacgtgtcgagcagcacgtggttgtgcacgacctgcaggctgtagatgcccgtgtagcacatcagcagctgcacgtagagcggcgtgccgcgaaacacgtacgtatagagccacaccgggcccgagatccagcggttcgacgacgcgcgcgcgatcgcgagcggcacggcgagcgcgaagcccagcgcaatcgacacgaccagcaaccacagcgtgatcgcgaggccgctgaagcggtagccgtcggtgtagagatagctttgccagtactggctgacgagttcgatcacagtgcgagcctccggacgccgacggaataacgcttctcgaggtgatgcagcacgacgttggacaccgtcgtgatcgcgaggtagatcgcgcctgccgcaagcgtgaagaagaagaaatcgagcgtgctcttgcccgcgtcctgcgacgccttgacgacgtcggcaaggccgatgatcgacacgagcgcggtggccttcacgagcacctgccagttgttgccgatgccgggcagcgcgaagcgcatcatctgcgggaacaggatgcggcggaacacgcgccagccgctcatcccgtacgcgaagcccgcttcgagctggccgcgcggcaccgacaggaacgcaccgcggaacgtctcggtgaagtacgcgccgtagatgaagccgagcgtgatgacgcccgccacgaacgggtcgatgtcgatctggtcccagccgagcatgtcggtgaagttgttcagcaggatctggatcccgtagaacagcagcaacatcagcacgagatccggcaccgcgcggatcagcgtcgtgtagaaggtgccgatcgacttgagcacgcggttcgtcgacagcttcgcgctcgcaccgatgaggcccagaacgagcgaggcggccagcgacagcaccgcgagcttcacggtctcgaccgtgccggcccacagaagcgggccaaatccttggaagatcatagaagggatccagaacgaagtggctggattgtcaatagccattaaccgcgcatcaaacgatatctgcgcactacctgatgcgacccgctcatcaagccggacgcatcccgcgaagcggattgcacccggcaacggatgcggcgcgcgccgcaggcgatgcgcgccgcacggacggtcagccgccgtagacgtcgaatgcgaagtacttcttctcgagcttcttgtacgtgccgtccttgatgatgtcggcgatcgcgtggtcgatcttcgccttcaggtcggcgtcgtccttgcgcagcccgatgccggcgccgttgccgagcgtcttcggatcgtcgatgtccttgccggcgaagtcgaagctcgcgccgcgcggcgtcttcaggaaaccgatgtcggcctgcaccgcgtcctgcagcgccgcgtcgaggcggcccgacatcaggtcctggtacacgccgtcctggttctggtaaggcgcgacccgcacgcccttcggcgcccagtacgtcttcgcgtaggtttcctggatggtgccctgctcgacgccgaccgacttgcccttcagcgattcggccgtcggctgcaggttcgcgcccttcttcgcgacgaggcgcgtcggcgtgttgaacagcttgtcggagaacgcgatctgctcggcacgcgccggcgtcatcgacatcgacgacagcacgccgtcgaacttcttcgccttcagcgcgggaatcatcccgtcgaagtcgttctcgatccacacgcacttcgccttcaggcgggcgcagatctcgttgccgagatcgacgtcgaagccgacgaccttgccgcttgtgtccttcgattcgaacggcggatagctggcgtcgacgccgaaccggatcgtcgaccaatccttggcgtgggcaccgaccgcgatgcaggcaagggcaatactgagcgcgagtttcttcatggcgttcctgtcgtggacgaactgggcaagggtcccgtcggacagcccgcaccggcgcggccggcacggcgccccgccgtgaacccttccaacccggacatcgcctcgtccggcgaccgcccaagttgtacatacaactttgcccgtgcaggcgcaccaccagcaatccgtgtttatctctaattgtcggcggattatggccgtggatcgtaaattcccttcaatttcaattaattacgaattacagcgagctaaacgacagctttctccgcatgcgggttcgtggccgggagcgggttttcacctgtctagacctgccgacgccgcatcacgctgcccgtccgtcatgccgaccgtttccagaccgaccagccggtagccgaactgcagttccgtcaacaggtgccgcgggcgcgccggcaccggttcgagcttctgccgcaggttcgtcatgtacacgcgcacgtagtgcgcgcgttccgcgtcgtggatccccacacctcggccagcaattgccgcgcggcgaccacgccgccgcgcgcgcgaatcagcgcggcgagcagccggaattcgaggcgcgtcagatgaaccggctcgccgccgcgggcgacttcgtgcttgccgagatcgacggtcacgtcgccgaagcgcacgatcgacgacgattgcccgtcggccgacacgaacgccgcgcgccgcaactgcgcgcgcgcccgcgcgagcagttcgggcacgccgaacggcttcggcaggtaatcgtccgcgcccgcgtcgagcgccgcgaccttctccacctcctgctgccgcgccgacagcacgatcaccggcaccgtcgaccattcgcgcagttcgcggatgaacgtcttgccgtcgtcgtccggcagcccgagatcgacgatcacgagatcgggcttgctgctcgacgcgtacatccgcgcctcgcgggccgtcgacgcctcgcaggtgtcgagccctcctgttccagtgccatccgcacgaaacggcggatgtccgattcgtcctcgacgataagtacgcgcgatctgatcatgtccggctctcgtgttcgatgtcgggtggcgcacccagtggcaggcgaatctcgaaccgcgcgccgtgcggatcgagcggcaccgcgcggatcgagccgccgtgcgcgttgacgatgctgcggcacagcgcgagcccgagccccacgccgctgatcgacgattccttgcgctcgcgctcgaacggctcgaacagcggctcggtgttgcgcgcgacgaagccgggcccgtcgtcctcgacgaacacatacagcgtttcgccgaacacgcgtgcgcgcaccgccacggccgcatccgcgcccgcgtacttcgccgcgttgtcgagcaggttcatcagcacgcgctcgatcagcagcgcgtcgacgtcgatcagcggcaggtcggccggcaggtcggcgctcacgtcgcggccggccagcacgccggccgaatgcgcgagcgcgctgccgacgatctcgtcgagcatgtgccactcgcgattcagccgcacgccctcgctctgcatgcgcgcgagatcgagcaggttcacgacgagcccgtgcagcgcctcggcctggttgcggatgccgtgcgcgagcgcggccggctgcccgtcggccagccgctcgggccgctccagcgtctcggcgagcccgcggatcgcggtcagcggcgtcttcaggtcgtgcgacacggcggcgagcagcgcattgcgcagccgctcgccttcgatccggacgagcgtgtgctgcgcgacgccgacgtagtgcacgcgttcgagcgccatcgcgatcgacgagcacagcgcgtcgatcaggcggcgatcgtcggggtccgtgggtaccggctgcgcgtcgccgaacagcacgagcacgccgcgcacgcgcatcggcgccttcagcggcaggtattgcgcggccgcgcgctcgaacggcggcagcccgcacccggcgccgcgcgcgttctcgtaggcccagcgcgcgatcggcgcttcgacgaacgcggcgtgcggcgccggcatcagacggtcgtccgcgtcgggcagcacgagcgcgacgcgcacgccgagcagcggcgcgatcgtgccggtgcagatcgatgcgatctgttcggtttcgatcgccgccgacagatcatgcgcgacacgcgcgagcgcggccgagcgcttctcgttcgcgcgcgcggcccgcgcctccgcgcgcaggcgtgccgcgagctggccgatcgcgagcgcgacggcgagcatcagtgcgaacgtgaacacatactgcgtatcggacaccgcgaacgacagcctcggctcgacgaagaagaagtcgaagcagccgacgcagacgaacgcggcccacgcgccggccagccggccgagccgcagcgcgatcagcacgacggtcatcaggaacagcatcacgacgttcgacaggtcgaacacgcgcagcagcgcgctcgccgccagcgtcgccagcgcgcacacgagcgtggcgagcagcagcggcaccgcgtactgcgacacccacacgtgcgtgcgcgggtgcgcctcgcgcacggccagcgccggccgcgtatccggccccgcgcccgcgatgcggtcggccagcgccgcgcacgcgcgcagcacggctcgccagcggtcgcggcgcgcgccggcccgctgcggcgggcagcggtgtcccgccgcctcgttgcccgtcgattcgcatccttcacgttcacattcacatccatgatcgcttccggcaattgaaacgccgaacggccccgcgcacgccgcgaaggcgtgagcggggccgcgttcggtcagataaacggcgtcaacagcatgtcgatcagcttgatgccgatgaacggtgcgacgattccgcccacgccgtagatcagcaggttgcgccccagcagcttcccggccggttccgcgcgatacttcacgcccttcagcgcgagcgggatcagcgcgacgatgatcagcgcattgaagatcaccgccgacaggatcgccgacgtcgggctgtgcaggcccatcacgttcagcgcgccgagcgccggataggtcgcgacgaacgcggccgggatgatcgcgaaatacttcgcgagatcgttggcgacgctgaacgtggtcagcgcaccgcgcgtcatgatcatctgcttgccgacctcgaccacctgcatcagcttcgtcgggttgctgtcgaggtcgaccatgttggccgcctccttcgccgcctgcgtgccgctgtgcatcgcgacggccacgtcggcctgcgcgagtgcgggcgcgtcgttggtgccgtcgcccgtcatcgcgacgagatggcccttcgcctggtgctcgcggatcagccgcagcttgtcctcgggcgtcgcttcggccaggtagtcgtcgacgccggcttccgccgcgatcgccgccgcggtgagccggttgtcgccggtgatcatcacggtcttcacgccgaccttgcgcaactcggcaaagcgcgcggcgatcccgtgcttgacgatgtccttcagctcgatcgcaccaagcacgcgggtgccgtcggcgacgacgagcggcgtgccgccgcgccgcgcgatttcgttgacggccgtctcgaccgcctgcggaaacgcaccgccgagcgcatcgacgtgcgcgcggatcgccgacgccgcgcccttgcgcacctgccgcccgccgatatcgaggccgctcatccgtgtgcgcgcgctgaacggcacggcaaaaccgccgtcgatcggcttgccctccagcgagaaccgctgtttcgcgagcgcgacgatcgaacgcccttcgggcgtctcgtcggcaagcgacgacagctgcgcggcctcggccagcgcacgctcgtccacgccgggcgccggccggaactgcacggcctcgcggttgccgagcgtgatcgtgccggtcttgtcgagcagcagcacgtcgacgtcgccggccgcctcgatcgcgcggcccgacgtcgcgagcacgttcgcgcgcatcatccggctcatccccgcgatgccgatcgccgacagcagcgcgccgatcgtcgtcgggatcaggcagacgagcagcgcgatcagcacggtcaggctcaccgccgaacccgacgcgttcagcagcacgctgaactgcgagaacggcagcagcgtcgcgcacacgagcaggaagatgatcgtcagcgcgacgagcaggatcgtcagcgcgacttcgttcggcgtcttgccgcgcttcgcgccctcgaccatcgcgatcatccggtcgagaaaggcctcgcccggctgcgcggtgatcttcacgacgatccagtcggacagcacacgcgtgccgcccgtcaccgacgaaaatcgccgcccgactcgcggatcacgggcgcggattcgccggtgatcgccgattcgtcgaccgacgcgacgccgtcgatcacttcgccgtcggcgggaatcgtgtcgccggcctcgacgagcacgatgcttccggcggcgagttcgtcgctcggcacgcgatggctggtgctgccgtaccgcttcggctcgtcgagcaccttcgcgtacacgcgcttgcgcgccgcacgcagcgcgtcggcctgcgccttgccgcgcccttcggccagcgcctcggccgcgttcgcgaacagcacggtgaaccacagccagcacgcgaccgcgaagatgaagccggccggcgcatcgcccgtgccggtcagcgcctgcagccacagcacggtcgtgacgatgctgccgagatagacgacgaacatcacgggattcttcaactgcacgcgcggcgcgagcttgcggaaagcctcgcgcagcacggccgtccggcgcatcggcggcacggcgccgaccgggatcgccgccggattgatcggggtttcgatatgggacatgagtgactccgtggttcctgccgttacttcgcgccggccgcctggccgaatgcgcgatccagcgcgaggttcaggtcgagcacgcgcacgcgcggttcgccgagcacgccgagctggcgcggcgatgcgatgcgttcgaccagcgccgcgacctgtgcggcatcgacgccgcgtgcctgcgcgacgcgtgccgcctgcagccgcgcgttcgccaccgagatctcgggatcgagccccgatgccgacgcggtcacggcatccgccggtaccggcgtgccggccgcgagcgcgttctcctgccggtatgcgcgtacccgctgcgcgatatccgcgaggagcttcctgctggttgctcctggttgctggcgccgctgccggccgcgttgtacggctgttcgaccgtcttcgacggatcggccggatcggtgccggtcgtcgcgctcggccgcccgtggaagtagcccgcgcgcgtgaaggactgcccgatcaccgtcgagccgatcgtcgtgccgttgcgctccacgagactgccgcgcgcctgcgacgggaacagcacgttcgcgacgcccgtggtgagcagcggatacgcgatgcccgtgacgagcatgaacagcaccgacgatgcgatcacgggccgcacgaggccacgcgtcgccgcgccgaacgaagaaccgggtgccggcgcggcggcggccgctgcctggcgattgccttgcatcatgatgttttcctcagaacagttggccgcccgacatcagcaggtgctcgacgaccgggccgagcgcgagcgcgggcaggaacgtgaggccgccgacgaccaggatcacgaagaccagcaggccggcgaacaggcccgtcgacgtcgacagcgtgcccgcgctttccggcacgctcttcttcgcggcgaggctgcccgcgaccgcgagcatcggcagcagcgtcaggtagcggccgatcagcatcgcgaagccgatcgtcgtgttgaagaacggcgtgttcgcgttcaggcccgcgaacgcggagccgttgttggcggtgcccgacgtgtacgcgtacagcacttcgctgaagccgtgcgggccgaggttcgcgaggctgtccatcgtcgagtgcagcatcgcggccagcgctgaagccgaggatgctgaacggatgcgcgagcaccgcgagcatcacgagcttcatctcgcgcgcctcgatcttcttgccgaggaactccggcgtgcgcccgatcatcatcccgaccaggaacaccgtgaggatcgcgaacgtgaacaggttgatcagcccgacgccgtcgccgccgaacacgttgttcagcatcatctgcgcgatcggcacgaggccgccgagcggcgtcagcgagtcgtgcatcgcgtcgaccgagccggtggtcgcggcggtcgtgacggtggcgaacaggctcgtctgcgcgatgccgaagcgcatctccttgccttccatgttgccgcccggctgcgcggcgctcatctgctggtcgacgccgagcccggccacgagcggattgccgtgctgctcggccgaatagatcacggccaggaagccgacgaacatcacgacgaacgcaccgaggatcacccagccctggcggcgccggccgatcatcgtgccgagcgtgtatgtcagcgcggacggaatcagcagcatcgacagcatgtgcagcgtgttggtgagcggcgtcgggttctcgaacggatgcgcggcgttcatgctgaagaagccgccgccgttcgtgccgatgtgcttgatcgattcgaggctggcaacgggccccgtcacgatctgctggcgcgcgccttcgagcgtggtcgcccacgcatcggacgcgagcgtctgcggcatgccctgccacacgtacacgagcgccatcgcgaagctgagcggcagcagcacgcgataggtcacgcgcgtgaagtcgacccagtagttgccgatgtccgccgcgctcttgcggctcaggccgcggatgaagccgcccgcggccgcgacgccggtcgccgcgctggccaccatcaggaacgtgatgacggccatctgcgagaagttcgacaggctgctctcgcccgcatacgcctgccagttcgtgttcgtgatgaacgacgcggcggtgttgaacgcgaggtcggggctttgcgcggcgcgctgcagcgcatcgaacggcagcgtgtcctggatgcgcagcagcagataaccgagcagcatcatcccggcattgctgagcagcagcaccatgccgtagcgctgccacgacatcgcttcgtcgggattcacgccgagcagcgcataggtacggcgttcgacccacgcgtggcgcgggctcgtaaaggcgtgcgcgagccatttcccgacgacgggcaccagcgccagcatgatcgcgagaacgatcgcgaattgaatgagattgttgaacatgtcgacgctcgctcagatccggtcaaggccggtgatgaaaccggccgtcaaggcaaagaacgcgagcgtgaacagaatgaaaagcagatcgctcatgacatccaccgatatttttcgaattcctgttgaatcgcgccgatcaataccgctcgggtttgatcaaggcatgaaacagatagataaagagcgcgagcgacagcgcgccggtgatccacaacatgactttcccctttttcgtatgcgcggcgacaccgcgcgctcgtcggcgtggcgggccttgccttgccggcgcaggcccgtgtgacgcccccatgctcggctggcgaatgggatgcgacagtgtagaaatccgcgtatcaaagcggtgttcaatttctttacaaggaataaaaagccgtaaagacgaaagccggccgacggggcatttttatgcgttcttttcagggcccgcgcgagtctatacaccgtatcgtcaccgcgattcctagaatgggcggcatgtcaaagacgagatctccgcggtgcggagcacgatgcgaccggggtgccagcatgaaaccgaccagaaccgaaaccgccgcttcacgcgctctgccgcccgttcgttcgcggcgccggtaccccgccgacgaacgcgtgctgctgtcgatccgcgtcgaatccgacaacctcgccgtcgtgcggcgcctgctgcaccaggcggtcagcgccgcgctcaatttctacacggccgcgatcgacaagcgcaccgggcgcgcctgcatcgagctcgaggtcgcacggtcgcaggcatcgccggccatcctgtcgatcctccgcctgctgccggccgccgagttcggcacgatccgcctgttgcagcactagcggcgttcgccgcggccgcgcgtgacacgcgtcacgcgccgcctcccttttcaacgattcatcgattcatcgattcatcgattcgaacgcgtgttccggcgcgaacgcgcgacgaatcgtcgttcccgtcgcgacgggcctttccaggaagcactcgcaatgaaaaagcagtcgtcggtaccctttccctcgcattcttcggcgccgccgcgcatgcgcaaagcagcgtcacgctctacgggatgctggatgcgggcatcgcctatacgaacaaccagtcgggtaaagcgcgtggcagcaaggcagcggcctgctgtcgaatacggtcttcggcctgagcggcaacgaggatctcggcggcggcctgcatgcgctgttccgcctcgagaacggcttcaacctgaacaacggcacgcagtcctaccggaacacgatgttcggccgccgcgcgtacgtcggcctgcagagcgaccggtacggtgcggtgacgctcggccgccaatacgatgccgtggtcgactacctcggcccgctcgcgatggcgaacaacggcgacggcaacaatctcgcgtcgcatccgttcgacaacgacaacatcgacgattcgttctacatcgacaacgcggtgaaatacacgagcccgacgctcgccggctggcagttcggcggcctgtacgggttcagcaacgcggccggcggcttcgcgaacaaccgcgcgtacagcgcgggcgtgtcgtatgcgaacgggccggtcagcctcggcgccgcgtacctgcagctcaaccgcggcgggctgacggccggcggcgcgctgtcgacgaacgacggcccgaacttcccggccgtgcgccagcgcgtgatgggcgcgggcggcagctacgccttcgaccggctgacggtcggcgcgctgtggacgcactcgatgttcgacgaaacggccgcgtcgtcgctgcccggcgcgctgaacgcgctgcgtttcgacaacttcgaggtcaacgcgcgctacacgctgacaccggccgtctccttcgcgggcgcctatacgttcaccgccggccgctacgacgacaccaccggcagccaccggccgaaatggcaccaggtgacgctgatggccgactacgcgctgagcaagcgcaccgacgtgtatgcggagacggtctaccagcaccagttcggcgtgccgtcgggcgcgacgctcggcttcgcgaacgtgacggggctcgcggcttcgtcgaccaacacgcaggtggtcgcgacggtcggcatccggcatcggttctgaccgcgcgcggactgccgcgggccggccgctctgtgcaatcccgcatggacgcgcgccggccgaacagggatcattcgggaaatccgggcccgcacgcccgcgaaaccggtacactcggcgccgggcgcgcgccggatcggcattcggcggcgggccgccgccgactctggaaccgtgatcccatgaccacaccgatctatcaggaaatcaaggacttcatcctcgcgcgcattcatgccggcgaatgggcggaaggcgaccaggtgccgtcggagaacgaactcgcgcgcgaattcaacgtcgcgcggatgaccgtgaaccgcgcactgcgcgaactgaccgccgagcaggtgctcacgcgcacgcgcggctccggcacgtacgtcgcgtcgccgaagtacgaatcgacgctcgtcgcgattcgcagcatctcggacgaagtcgccgcacgcggccacggctatcgcgcgcaggtgctgctggtcggcgcggccgtcgccgacgcgaagctcgccgacgaactgcagctcgacaccggcagcccgatcttccattcgcgcgtgctgcacttcgagaacgacacgcccgtgcagctcgaggaacgctgggtcaatccggcctgcgcgcccgaatacgcgttgcaggacttcacgacgacgacgccgaaccagtacctgacgcgcgtcgcgccgttgcagcgcgtcgaataccggatcgaggccgcgatgcccgacgccgaaacacgccgccacctgacgatggacgaccgcgagccgtgcctgctgctgcatcggcgcacgtggtcgcaagggatggtcgcgtcggtcgccaacctgtggcacccgggcagccgctatcgcttcaccgggcatttctgacgtcgacgcgcgggctcaccgcgcgcccggccgtccccagcgctcgatcgcactgacggccagcgtcaggccgtcgtcctgcgcgatgcgcgcgccgagttccgttgcgcgcgccttcgtgtcgccgcgctccgcgaacgcgatggcccgcgcaagcgcggcggcgtccacgcgccgccccgcgaccggcgcatccgcgacgccgagccgctgcagccggttcgcccagaagaactgatcgcccgcgaacggcacgacgacggacggaatgccggcccgcgcagccgaatgcgtggtgcccgacccgccatgatggatcgccatcgacacacgcgggaacagccggtcatgcggcgtatcgccgatcacgtgaacgtgcgcgggcagcatcgacgcgtcgataccgctccagcccggatggaacagcgcacgccggccggcgagcgcacgcacgagcgcatcggccatcccggcgcgatcgaagccggccatgctgccgaaaccgatgtacacggggatcgcccgcgtcgagaaacgccgcgagatcaggcggcggttcccattcacgtgcatcgattcgccactggccgcaggccagcgcctgcgacggccagtcggccgggcccgacagcagtgccggcgacacgccgtacagcatcggatgatcggtccacacccgcctgcgcggcggcaacccgcacacgctcgcgcgcgccgcgttcgtcgacttcctgaacgcctgccacaacagcgcgttcacgaaccggtggctcgcgcggttcagccagcgcggcaccttccccggcggcaggaacggcgatgcgaatgccgcggtgggcgtaatcgggatcatgccggcgccgatcgccggcacgccgcgatactcggcaaccgacaagccgacgaacgatacgagccccgacacgaggatcgcgtcgcacccggccgacgcatccgcgacctgccgcatccacgcggccgtgttcgcgttggcgatcgccgcgagcgccttcgacgtgtcgttgaagccgccgcgcccgcgtatcgcatcggccaatgcgccctccggcgcaatcgcgcggcggatatcgccggacaacgccgccgacggcacgccgagcatggcggccgagccgagcgtcgccgcgtcggccagcagccggacgtcatggccggcatcgatcagcgcacggccgagcgccgcgagcgggcgcgtgtcgccttcggtgccgtaggtggcgatgacgagtttcatgcgtgactccttgcacccgacggaggcaggtggattcataaaagtgcacgtcgtatactaatgcaattcgtacacttttatccgatccctctccatgccgacaccgaccgacgatccgggccgccgcgcaagcgcatccagatgctcgcgcacctcgccgccaccggcgcacgcctgttcgacgcgcacggttacgatgccgtcacgatggagcagatcgccgcgcaggccgatgtcgcgaagcgcacgctgtacaaccactttgcgacgaaggaagccgtgctcgcgcactggctcgaaggcgagctcgcgcgcgatctcgcccatctgcagcgcgatgtcgcgcggcgcaagacgttcgtgtcgcgcctcggctgcgtgctcgatgcatcggccgcgtggtgcgagcagcatcccgcgtacctgctcgcgtatctgcgccatcgtttcctgagcatcggcgtggccgaaccggaaagcagcaacgagaacggcagcgatatcgcgctcgtgtggcagcagctgatcgcagccgggcagcaatcaggcgaactgaacggcacgctgcgggccgaccagctcgcgacgtggttccatcacctgtatctcgcggcgatgctgcgctggctgaccgtgccgggcctgtcgctgaaacgggaattccaggcggtcgcgaagctgtttgtcgaaggcgcggaagcgaaacgctgaacggcgccggtgatgcatcgagcgacgcagaaccggccagcgcagcgcctccggtgaatacggtgcgatggcgcgcgtcgcgcggcgcatacgcattttacgacgaacgcatgcatcgcatgccaaatttcccgcgcggcagtatgctggcgacgtacggctgcgcacgacgcctcgggtaatccctgtatcggcacatcgtcgcgcggccgtcgcgaccgcaatcatgcgttgcaaggagggattcgtgatggcaaccacgcatcagcacttccacctcgaactacggcacgccaccgcgccgacctatttcatcagctacctgtttcccgccttgctgttcgtctacgaactgctgcgcgtcggccaatggatccgcgatcacgggatgcagttcgccgcgttcaagcagatgggttacgagtatctgctgatgctgctgttcgtcggactgcagattctcgtcgaggcgatcttcctgctcggcgccgcgatgcgccgcgacaatcgcgacttcgagcaccggctgccgaacgtgatcctcgggatcggctgttcgatcgcgttgctcgcgatcgacctcgcgatccagctcgccttctgacggccggcgggcccgcgcccgccgacggcagccgcgctcaggcgagcgcgtcgcgcaggaacgtcgcgatggcggccagcacgtcgtcggtccgctcgcggtgcggcatgtgcccgcaccggccgagcaacagatacgacgacggccccgcgacgcgcgcggcgatccgcttcggatgcacgtcggatccgtattcgtcgtcttcgccgtgaatcgcgagcgtcgcgcattgcacgcgcggcagatcgtcgtcgagactccagtggcgaaacgcgggcgacagccacgtgtcgacccacgcgcgcagcacccattcggccttgtcgccgtgataacgcgcgagccggtcgagctggcccggctcgtcgaactgctgccccgcgtcgcgaatgccggccagcgtgcgatcctcgacgaacgcctgcgcggcgatcgtcacgagcgcacggcaacgcgccggataggcggcggcacacccgaccgccatcccgccgccgacgctgtgccccaacgcgacgaacgcatcgatatcgagttggtcgagcaatgccgcgaacgcatgatcggcctcgtcgcgcacgaacgtcgtgccgagcttccccggatgccgatccgaacggccgaagccgaggcggtcgtaggcgatcacgtcgcgctgcgtggcgctcgcgagctgcgcgggaagtcgcgccacaggtcgacgcagccgagcgaatcgtgcagcagcacgatcggtgcggccggcttaggcgcggccggctcaggtgcggccggctcggaggcggccggctcgggcgcacccgctgcccgttgcgccgggccgccgcgccagcgtttcgcaaagaggcgcccttgcggcgtctcgacggttgtctcctcgatcggaatgtcggtcatgtgcctgtcgtctgcatgaaagcggccgcacctcggcggccttgccggatccggcgatgttggcccgcgcccgcgcacagcgtcaagcaagccccaccgcccgcgcgttcattcgggctgcggcggcagatactccatctgcgcctcgtcgtacagccggtagatcagcgcctgcatcgcgcgaatgtcctccgattcgtcgagcatccgcatgctcatgatgatcggcgacacgaggttcggatcgtcgagcggcttgtagctgatgtcgtcgcgcttcagcccgtacacgctgtgcggcaccaccgacacgccctcgcccatcgcgacgagaccgagcgcgatctgcagttcgcgcgtctcgtagatcttgcgcggctgcagcgcgcgatcgtgaaaggccgcgagcacctggtccgcatagctcgggcgcggcgccttcggaaagatgatcagcgtgtcgttcacgagatcgtgcagcgacagcacgggcttcgcgctgtcgagcacatggccgaccggcagcgcgacgatcatccgctcctcgcgcagcacgacgcgccgcacgctcgggtcctcgtggcggatgcgtccgaacccgacgtcgatgcgcccttccttcagcgccttgatctggtccatcgtcgacatctcgtgcaggctcagctcgacggccggatactcgctgcgaaagcgccggatgatcttcggcagcatcccgtacagcgtcgagccgacgaagccgaccgacatgctgcgttcgatcttgccgacccgcttcgtcatcgattcgagctcggtcgtctgtgcgagcagctgcaccgcgtgcgaatagaagaagcgccccgcgtcggtcagcttcagcggccgcgcgttgcgctcgaacagcggcacgccgagcgcttcctcgagctgctggatctgccggctcagcggcggctgcgcgatatgcagccgttcggccgcccgcgtgaaattccgctcctcggcaaccgcgacgaagtagcggaggtgtctcaactccatgttcgatgtctcccggacagcgatccggcggtcaaccctggccggacgatgtcgtcacgataccgcaggcggcgcaatccgccacgcgcggccccggcgccgtgccgcccaacgcaaaacgggaagcccgcgagcttcccgttgcctgatcggcgccgcggcagggcggcgtcacgcgccgtccgtcacacctcggtcgcgtagagcgcgtcgcgctgcgcgtcgctcagcgagtcgagcggcacgtccggcagctggtagcagatcatcgtgccgtacagctccgcgaggcaattgctgccggcgtcgagcgcgtagccgtcctcgccgtcaggcgccggcgggtacacttcgcgccacgcgttgatcgcggcttcgattcgcacgatggaaacgggtccggccttccgctcggcgggtgatgcgctcatggattcctctgggttgcgcgctccgcgggccgtgtcggccccgatggaacgatgaaaacgccgggcatctcgccggccgccgcaccgcgcgcgcgccggatgccgatccgcgctgcgcgcctcgcgctggccgggccgtggcccggtagggtcgggcaatataaccggctttgaccccgtgcaggcaaaagccgggcaaaaacgggaagcgcgcggcttcccgtttcatcgcatgccgcgcggctgtacgccgcgcccgcgtcagcccgcggtttcgcggttcgccaccggctgccgctgcgcgccgcggctcgcggcgacccacggcgcgatttccatgtcctcgtagcgcacgaaacggctcttcttcacgaaccggaagccgagccacacgacgaggaacagcggaatgccgatataggtcgcggccacgccggcccagtcgatccggttcgcgaggaacgcctgatagtcctgcccgagcgcgatcacgaggcacagcacgaatgcgaacagcgggccgaacgggaaccacttcgactggtacggcagctggtcgagcgcgtagccctgcttcacgtagcccttgcggaaccggtagtggctgaccgcgatgccgagccatgcgatgaagcccgtcatccccgacgtgttcagcagccacaggtacacggtcttgtcgccgtacagcgacgtgaagaagcacagcgcgccgacggccgtcgtcgcgtacagcgcgttgcgcggcacgccgccgcgcgacagcttcgcgaagatcctcggcgcacggccttcggtcgcgaggttgtagagcatccgcgtggacgcgtacatgcccgagttgccggccgacagcacggccgtcaggatcaccgcgttcatcacgccggccgcgaatgcgaggcccgcgtggcggaacacgagcgtgaacgggctcacgccgatgtcggtcacgtccgtcttgagcaggttcgggtcggtatagggaatcagcacgccgatcacgaagatcgcgaacacgtagaacagcaggatccgccagaacacctggcgcaccgcgcgcgggatcgtcgtgcgcgggttttccgattcgccggccgcgacgccgatcagctcggtgccctggaacgagaagccggcgatcatcgcgacgcccatcaacgccggcaggccgcccgcgaacggcgcgtcgccgatcgtcaggttgccccagccgttgcccggcgcgcccttcagaatgccgaagatcatcagcaggccgacgccgatgaacgcgaccacggtgacgaccttgatcagcgcgaaccagtattcggcctcgccgaagccgcgcacggtcagcgcgttgagcaggaacatcacgccgaggaacgccgcgctccaccacacgcccgggacgtccggaaaccagtaatgcatcacgagctgcgcggcgacgagctccaccgcgatcgtcacggcccagttgtaccagtagttccagccgagcgcgaaaccgaagccctcgtccacgtatttcgcgccgtaggtcgcgaacgagcccgacaccggcatgaacgcggccatttcgccgaggctcgtcatcaggaagtagaccatcaggccgatcagcatgtacgcgaccatcgcgccgccggggccggcctgcgagatcgacgcgccggacgcgacgaacaggcccgtgccgatcgagccgccgatggcgatcatcgtcaggtggcgcgccttcagcgcgcgatgaagcttgggtgggttcgcggacgaaccgggttggtcggatttcggaagtgcggacataaacgagacgaacgttgagcgggccggcatccgtagccggcgcatgcggaatcggagcgcggggcgcgtcctgcgatgcattcgatgcggccccgatacgcgttgcgcggcgggcgcctgcggcgaagcgcggattctacctgattcgtcacggggacagctcgggtggcgccacccgcggcccatccggagatttcgcagaatcaaggggttggccgcgtcgcgaccgggtcaggccgggccgccgccgcgcgccggcgcaaaaaccatgcgtaccgggtggtcatccggttttccgctgccacggagtttctccgttggcttgtcgcaatccgccatctaccacgccggcatacataatcgccgggtaatcacgggattattcagacaaaatgaccgatatcggcaattgattcaaatcaaatcacccgcacctaaagcggtaacgatgcgtaaccgttttgaatcaccgccccggcatgcatgttttgcatgcgcacacgaatgtctggaattcgcgagataatgcggcccgattcgaaatcaacagcgagcggaatcgccaacgacgcgaaatccgccgcccgccaccctcgaggatgaagtcattcacgctgcccgccacgctgcgccgccatacggcgtcgatcgtggcacgcattctgtcgccccgcggcgtactcgttgcggggattttgctgctgatgttcagctggggctttccacggcgcttttaatcgaggcgcggcgcgatgcatatgaccatgcggtcgaaaatgcacgcaacctgatgctgctgatcgaacgcgatatcgcgcgcaatatcgagctctacgatttgtcgctgcagaacgtcctcgacggcgtggccgatccggaactgacgacattgccgccccgccagcgccatcggctgctgttcgaccgcgccgccaccggcgaatatctcgggtcgctgttcgtgatggatgcgcacggcaatatcgtgatcgattcgagcgcgtcgcccgcgcggcaaggcaactttgcggatcgcgactatttcaccgtgcaccgcaacgatgtcgcgcagggtctctatatcagccggccgtacgcatcccggctgcgcggcggcgcgctgacgatcgcgctcagccgccggatcacgctgcccgacggctcgttcggcggcatcgtcgtcggcacgctcagcatcgactacttccgcgcgctgctcgacggcctcgcggtcggcaagcacggcagcgcggcaatcgccgagctcaacggcacgctcgtgagccgcctgccctacgacgcgcgcgtggtcggcatcgacctgcgcaggtcgccgctgttcatcgaggcgctgcgcaggcgggaaggcgtgctgtcgggcgtcggcagcatcgacggcgtgcggcgcgtctatgtttacaagcatctcgccggcctgccgctgatcgtcgacgtcgcgcccgccgaggtcgacatctacgcgtcgtggcaccaccgcgcgatctggaccgtcgtgctgatgtgcctgttcaccgggttcatcgcgtggggatcgctggcgctgtcgcgcgaactgacgcgccggcaggtcgccgaatcgaagctgtaccggctcgcgcacaccgatgcgctgacgggcctcgacaaccgcggcacgttcgacacggtgctcgcgaaggaggcgcagcgtgcgtcacgcagcggccgcccgctgtcggtgctgttcgtcgacgtcgatcacttcaaggcgttcaacgactactacggccacccggccggcgacgacgtgctgcggcgcgtcgcgcaaaccgcgtcgcgctgcctgcgtcgcgacggcgatcacgtcgcgcgctacggcggcgaggaattcgtcgtcacgctgcccgacaccgatgcgcaaggcgcgctgaccgtcgccgaaagtatccggcgcgcgatcgcggagctcggcatcgagcacgtgaaaagcccgtacgggcgtgtcacggcgagcatcggcgcggcgaccgccgccgacggccgcctgaacgccgcgacgctgctgcggcgtgccgacgaggcgctgtaccgcgcgaagtccggcggacgcaaccgcgtgctggaagcgcagccgggcaccgcggacgcatgacatcgcgctgacgtgacgcgaaaccgcgcggcggccggccccgccggacgaccgcgccgtggacagccctgccgcgttcggctagcgttacgtctgctgcgcatgcggcgcggcgccggcccgcgcaggccgcgatgcgcgttccggccactccagctccgtcatgaccaccccgttccctgcccggctgcctccgctcctgcgcaacgcgctccgcccgctgctcgacccgtaccgccgctaccggcacgcgaagctgatccatgcggcacgcgtcgcgctcgcgattctcgtgtcgatcgcgctgtccaccggcctgaacgtgccgcacggcgagtggtcgacgattaccgtgctgatcgtcgtcggcgggctgcagcatcacggcaacatccgcaagaaggcggccgagcgcgcactcggcacgtcgatcggcgcgctcgcggggctcgggctgatcctgctgtattccgccgcgcacgcaccgatcgcgatctacctgctgatggcgctcgcgtgcggcatctgcgcgtatcacgcgatcggcaaggccggctatatcgcgctgctgtcggcgatcacgatggtgatcgtcgccgggcacggcgacaacgagatcgtcgacggcctgtggcgcgcggtgaacgtgctgatcggcatcgcgatcgcgctggcgttctcgttcgcgctgccgctctatgcgacctactcgtggcgctacaagctcgccgacgcgctacgcgcgtgcgcggccgtgcatgcgcgggtcgcgggcgaccgccaggtgagcgacgacgcgcacctgaaggaaatggccgcgctgagcgcgctgctcgtgcagctgcgttcgctgatgccgtcggtgtcgaaggaatgcgagacgtcgatgacgcagctcgaggcgatccagcgcagcctgcgcctgtgcatcggctatctggagatcctgtcgagcgcggtgccggcccgcgacgacgtcgcggcccgcgaatacatgcgcgtcgacatgaaggccgtgaaccggcgcatccgcgatacgctggtcggcgcgagccgcgcgctcaagttcggcacgccgagccggctcgcgccgcgccgccggccggccgacccaccgcacgacgcaccgccgccgcagctgtccggctacgtgtcgatcacggccaagctggccgtggaagtcgaccagttgcgcgagaagctgctcgacaccgcgcagtcgtggaacatctgacgctcgcggcatccgggcttcacgccgacgcctttcatattcctttcgaatcggcgcgccggcatcctgaccgctgcagccccgccattcggccgatccggccccggaaacacggccggcgtccgggctcatcggcgcctgatttgccgtgatttcgcgccgccccgggcggcgttctccacccggttaaccgcccgtcaggcccgccgcgacaggcccggcgacggttccggacgaaaatcaacccttgccccaacctcccggacagccgatactcgcatattccgcgaaatacgatcccaccggcttcaatccacggtaattcctatgagcacgattctcgaaagcctcccgaccggccagaaggtcggtatcgccttctccggcggcctggacaccagcgcagcactgcactggatgaaactcaagggcgccgtcccgtacgcatacacggcgaacctcggccagcccgacgaagacgattacgacgcgatcccgaaacgcgcgatcgaatacggcgcagccggcgcccgcctgatcgactgccgcgcgcagctcgtcgcagaaggcatcgcggcgctgcaaagcggcgcgttccacatcacgacggccggcgtcacgtacttcaacaccacgccgatcggccgcgccgtgacgggcacgatgctcgtcgccgcgatgaaggaagacggcgtcaacatctggggcgacggcagcacgtacaagggcaacgacatcgagcgcttctaccgctacggcctgctcgtgaacccggatctgaagatctacaagccgtggctcgaccagacgttcatcgacgagctcggcggccgtgccgaaatgtccgaattcatgaaccaggcaggcttcgcgtacaagatgtcggccgagaaggcctactcgaccgattcgaacctgctcggcgcgacgcacgaagcgaaggatctcgaaagcctcgagagcggcatcaagatcgtgaacccgatcatgggcgtcgcgttctggcgcgacgacgtgaagatcgccgcggaagaagtgacggtgcgcttcgaagccggccagccggtcgcgctgaacggcgtcgagttcaccgacccggtcgagctgctgctggaagcgaaccgcatcggcggccgtcacggcctcggcatgagcgaccagatcgaaaaccggatcatcgaggcgaagagccgcggcatctacgaagccccgggcctcgcgctgctgtacatcgcgtacgagcgtctggtcaccggcatccacaacgaagacacgatcgagcagtaccgcgagaacggccgccgtctcggccgcctgctgtaccagggccgctggttcgacccgcaggcgatcatgctgcgtgaaacggcccagcgctgggtcgcgcgcgcgatcaccggcgaagtgaagatcgagctgcgccgcggcaacgactactcgatcctgagcacgaagtcgccgaacctcacgtaccagccggaacgcctgtcgatggagaaggtggcatcgacgttctcgccgcgcgaccggatcggccagctgacgatgcgcaacctcgacatcaccgatacgcgcgacaagctgcgcgtgtattcgcaagtcgggctgctgacgccgggcgaagcatcggcgctgccgcagatcaagggcgacgacaagtaagtcgcctgacgccgctcgcgggccggtcgatttccgacacacccgtgagcggccggcttggtcaccggtcagacgctctgctccgggttcggctgtacccgtttgaccggcaacggcgcgagaacatcccacgcccgagggatcgcgctctccagataccatcgccaatacgatcggcgacttgcaccacctcccttctcctcccacacggcactgccggaaagcgccagcgccccgtaatagccgacatcccaatcgtccggaaacacgctttttcgttttcgccgaccacatcgaaattcgtgtcgtacaagatcgtattgatcgccgcgaaaacggtcatgccggcataaaccgggacaaacgccgcttcgccatgcccaaacagatcgatgacctgggtgtggtacgcgccattgtctctttccagacagaccaggtcatactttccggccagcgcgtcagcgccgttcgccaacatggcccgtgctgccgtcagcacgctcgcgtacggattcagccagtcgatcgcctcttcggcgcacagcatcgccaaccgcgcgcggcgcaagtatccggcgtcgacatgttcgtcagacgacaatgcctcgatcaaccgaagcagttccttcgcacagctgccggcagttccccgtcaggcgtaattgccgacagggccgccgacaacgcatccgtcaacgcttgcggaatatttgtcatctactcagattcacaataaggacaatacggcgcacgtcactttcggcacgcccgccttgagcgacacccgtgcgaattcccgcacgcggcccacccagcgcgacacgcatcttactgaccaaacgcgcgccgatccatcgcgatcaccggcgccgttcggcactgcaccgccgcgccagtcatggcaagctgcgagtcgttcgatttcttcgttgacccatgaccaccctgaccgtcatccacctgaacggcccgatcaacagcggcaagacgacgatcggtctcgcgctggctcgcgtgctgcccgacgcgcgcttcatcgacggcgacgatcacgatgcgcccgaagacgcaccgttcgacgtgcagtgggcaatcgcgctcgagcgtctcgtcacgcagatcgcgaacgcgcgcgagcgtcatctggtcatcgcctatccgatcggcgacacggaattcgggcggctgcgcgccgcctgcgaggcgcgcgatgcacggttgttcgtcgtgacgcttgcgccgcccgaagcgatcgcgtcgtcgaatcgcggctcgcgcgcgctgacggactgggagcggagccggatcgccgagatgtatcgcgaaggctatgcgtcgcggccattcagccagatggtgctcgatacgtcggacgcgacgcccgacgcctgtgcggtgcgtatcgcgcggaacgtcgcagcgacggagtcgtagaacggcacgaccaggaccttcacgatggattcgagcttcgacggcgagcgcttctaattcaaggctggcgactacgaccagacggccgtgtccggcacgccgctgacgacgcccggcacggttgtgaagttccatgcgccgacgctcacgcacagctgatcgtgcctctcgatgcatgaagcacgttgcgcaacgcgcaacatgaagccgggcgtgctcgcgatacgcgccggcccggcgtcccggcccaccggccgcgcctacgagtgatgccgcacgcccggcacggccgcttccctcgcacccttgcggctcagcatcagcgtgacgaccgccgacaccgcaagcgtgcccgccaccacgtagagccccgcggcataaccacccgtcacgtgcttcagccagccgatcgcgaacggcccgacgaacccgccgaggttgccgatcgagttgatcatcgcgatgccggccgccgcgccggcacccgacaggaacgcgctcggcatcgcccacagcggcgccttcgcggcactgatcccgatgttgacgacgaccagcgcgagcacggtgagcagcgcggtgcccgcctgccccgcaaacacgaagccgatacacgcgagcacgcacggaatcacgacgtgccaggtgcgctcgccgctgcgatccgaatgccgcgcccaggcgatcatcgcgacgaccgcggcgatgctcggaatgccggtgagcaggcccgtctgcagcgcggtgaagccgaactgcttgaccatcaacggcgcccacaggccgagcgtgtacagccccgccgacgtgccgaaatagatcagcgcaagcgccagcacacgcggatcgcgcagcgcctgccacgcgccggcggtatgcccggcatgcgtgtggcgtgcatcggcttcggctttcagcttcgcgaccagccagtcgcgctcgtccgcccgcagccatgcggccttcgacggcgaatcggtcaggcacctgagcacgacgaagccgagcacgaccgccggcagcgcttcgacgatgtacagcatctgccagtcggcgagcccgaacatcggcggcatctgcatgatcgcgcccgacagcggcgaaccgatcgcggtcgagatcggcgcggccgccatgaaccacgcggcggccaccgcgcgctgcttcgcgggaaaccacaggctcaggtacaggatgatgccggggaagaatccggcctcggccatgcctagcaggaagcgcagcacgtagaagctcgtcggcccggacgcgaatgcggacaccgccgacacgatccccacgtgatcatcacgcgtgcgatccagatgcgcgcgccgacgcgatgcagaatcaggttggacggcacttcgaacaggaagtagccgatgaagaacaggccgccgccgaacccgaacgcggtcggcgacaggccgatcgccttgttcatcgtcattgcggcaaagccgacgttgacgcgatcgagaaagctgacgaaataaagcagcatcacgaacggaatgatgcgccacatcagtttccgcgcgacgcgggtttccagatccgcttgcatgtgtctcctccttcgaggtcgagccgtgctctgccgtgaatgctcgccggcgccgccgcgaaacgggcgccggggcgcccgggcgcccggctcgcgtcggatgcgcgagtcgcgggcaggaaaacggggagacgatgaacgggcgacagccggtgaccggttgcgcacgcgcgccgccgctacgtcgcggcccgcccgcccatcgccgcccgtgtcatcaggcggcgatcgccgcgttcgcgacacgctcgcagacagccgccgtcacccgcgcggtcgtcgcgctgccgccgagatcgcgcgtgtgcagcgacgggtcggacgtcaccgcctcgatcgcccgcatcacgcttgcggcggcttccgcttcgccgaggtggtcgagcagcatcacgaccgaccagaacgtgccgaccggattcgcgagccccttgcccatgatgtcgaacgcagagccatggatcggctcgaacatcgacggatatcggcgctcgggatcaatgttgccggtcggcgcgatgccgaggctgccggcgagcgcggccgcgagatcgctgaggatgtccgcgtgcaggttggtcgcgacgatcgtgtcgagcgacgccggccggttgaccatgcgcgcggtcgccgcgtcgacaagctccttgtcccacgtcacgtcgggaaactcctgcgcgacctgcttcgcgatctcgtcccacatcaccatcgcgtgccgctgcgcgttgctcttcgtgatcacggtcagcagcttgcgcggacgcgactgcgcgagccggaacgcgaagcgcatgatgcgttcgacgccggcgcgcgtgaggatcgacacgtcggtcgcggcctcgatcggatggccctggtgcacgcggccgccgacgcccgcatattcgccctcggaattctcgcggacgatcacccagttcaggtcgccgggcccgcagcgcttcagcggcgcgtcgataccgggcaggatgcgcgtcggtcgcacgttcgcgtactggtcgaagccctggcagatcttcaggcgcagcccccacagcgtcacgtgatcgggcacctcggggtcacccgccgagccgaacaggatcgcgtccttgccgcgcagcgcgtcgaggccgtcggccggcatcatcgcgccgtgctcgcggtagtaatcggcgccccagtcgaaatcctcgaactcgaacgcgaagcggtcgctgccgcgggccagcgcctccagcacctgcttgccggccggcaccacttccttgccgatcccgtcgccgggaatcgttgcgattcggtaggtcttcatgcgcacatcctcgattgatcgtcagcgtggaggcactttaccgaaccaggagtgcaggaaccggtgctagactcaaagcatctttaacttgaattcatgaatcccgtcatggcggataccgtccagccggccgatctcggcttcttctcgacgctcgccgcctccggcagcctcagcgcggccgcgcgcgaactcgggctgaccgcggcggccgtcagcaagcggctcacgcagatggaacggcgcgcgggcgtcacgctggtgaaccgcacgacgcggcggatgatgctgacgccggaaggcgacgtgtatctcgactacgcgcgccggatcctcgaccagatggacgaactcggcgagttgctcggcagcgcgaagcagcgcccgaaggggttgctgcgcgtgaatgcgacgctcggtttcggccgcagccacgtcggcccggcgatttcacgcttcgtcgcgcggtatccggaagtgtcggtgcaactgcagttgtcggtgatgccgccgccgctcaccgacgacgcgttcgacgtgtgcatccgcttcggcgagccacccgattcgcgcgtcgtcgcgcggcggctcgcgccgaaccgccggctgctgtgcgcggcgcccgcgtatctcgcgcggcacggcaccccgggcacgccgcacgacctgacgcggcacaactgcatcggcatccgccaggggacgagggttacggcgtctggcgcctgacgagcgggcgcggcacggcgcgttatacggaagccgtgcggatcaacggcaacctgacgacgaacgacggcgagatcgccgtgaagtgggcgctcgacgggcacgggatcctgatgcgcgcggaatgggatctgcgcgactacctcgccgacgggcgcctggtcgtcgtgctgcccgatcacgaaacgccgggcgccgacatttatgcggtgtatgcgcagcgtcaccagatgtccgcgcggattcgggcgttcgtggattttctggcggaggagctggggcggttgaggacggtgcagggaaaatcgtaaggccgaggcaagccgccgtcgccatatgcgtgcggcaccgacgacgctcgacggccgaatcgccctgcacgtggccacggttcgctccgcatgcacacgggcttgtctcgccagggtgggcatcaaaggcaaatattctggcgaaacacggctcacgatcgccagaatatttgcatctcgatgcaccgccccgagcaggcgcacatggccgccgcatttcatctcgcgaacgattgaccgcccttcgttcagcgctccccgttcacgccactgccaccggactccctcgcgatcgttcatctcgacgacttccggcaccagttgtcgctccatggcccccgcgacggccacgccctcccggtcccgttcaaaccgctcgacgatccagtcgacgaacgcgcgcacgccgggcgacacatgcgggcgcttcacgtacacggccgacaccgcgatcgcacccggccgccagcgcggcagcacttcccgcaaccgccccgcgtcgatcagcggctgcgcggcgacgcgcggcggctggatcagcccgaggccatgcacgccgcacgccaggtacgcctgctcgtcctccacactgacgatcccgtcgagccgcaccttgcgcaccgcgccatcgacgaggaaatcgagttcggccgtacgctgccccggaaccgacgacgcgccgaccgcacgatgcacggccagatcgtcgagcgtgcgcggcgcgccgtggcggtcgagatacgcggggctcgcgcatgtcacgcgctcgagcgtgccgagccggcgcgcaacgagcgacgaatcgggcagttcgccaagctggacgctgcagtcgatcgcgtcgccgatgcgatcggccgggcgcccggatacgcccagcgtcagcgccagatcggggtgccgtgcatggaactcgccgagcgccggcagcacgatcgcatccgcgaccgccgccggcagctcgacgcgcagcggcccgctcgggtgcagggcggcgccgcgaatgctggcctcgagctcgtcgacgtcggccgtgatgcgcacgcagcgccggtaatacgcgtcgccttcgggcgtcgcccgcagcgcgcgcgtcgtacgcaccagcaacggcatgccgagcgccgtttcgagctcctgcacggtccgcgtcgcggtggcgcgcgaaatgccgagcgcctgcgccgcgcgcgtaaagctgttcatttcgacgatgcgcgtgaagatgcgcatcgcgcggatcggattgtccaccggacacccctgcatgtttgccgcatgccgcggcgcacgcttgcgcgcccgccgtgcatgcgtatcgaggaacgccgcgccgccggcgcggcagacggttcagccgttcgccgccgcggcgccgcgcgccgggtcgtcgagcagccgttgcgccagcgcgagtgcgtcgtcgcgggtggcggccgcgttcagcggataaccccagaccttctcgaacgcgcccgagaacgcgtcgagcgccgcgcgcgcgcggcgtcgggctcgatcgcgatcatcgctgggatccattcgtgcgactgcgcgcggttggccttgctccacttcgcgagctgcttgcgcaactcgtgatcgtcggcgccgcgttcattgccggacggcgcatcgtcggtcagaagaacgaacggttcgcgacgcgcgagcaatgcgtcgagttcggcgatcaggcgggcggggtcggtgtgcgtcgaaccggtgtaacgcaaccagacaaacgggaattcggtcgtggtgatgtgcatgtcggcccccagatgagaacgattctcattttatggatcgaggcccgcggcgtcatttatcgtcccggccaaccgcttgcccgatccggccaatcgcgcccggatggcgcgagtcgcgcggttcagcgttgccggtcggtcaggaattgcgtcggcgacttgccggtcgccttgcggaacatcgtcacgaagctgctcgcgctctcgtagccgagctcgatcgcgatctggtgcacgcggcggccggtcgtcagcatccgcagcgacagcgcgacgtgcagccgccggcgccagtcgccgaggctcatcccgagctccttcgccgcgagccgcgtcaggctgcgctcgctgatgcccgcgcgccgcgcgagctcggccagcggcgacttgtcggccggatcggcgagcagatggtcgatcagcttgcgcagccggcgatcggcgggcatcggcaggtacaggtcctcgaccggtgcggcgacgagttcgtcgagcagcgtcgccatcagccgcccctgcggcccgtcgacgtcgtacaggttcggaaagctcgccgccttcagcagcagttcgcgcagcagcggcgacaccgacagcgtgcagcagcgcgcggggaggtcgagagcggcatccggttcgaccagcaccgcgtagaacgtcgcgccggccgagccgcgcgccgcgtgcggaacgtcgcccggaatccataccgtgcattgcggcggcgcgctccacacgccaccgtcgatctcgcaatagatgacgccgctcaacgtgtagagcaactgcgcctgcggatggctgtgccgctcgagccgccattcgggctcgacgaccgagccgccgaacacgacgagcggacgcggcacgtggaagacttcgtcatccgctgcgggatcggtggtcggaggaagctggcgcatgaaacggtggacgatggaggaagccggacgccctgcccgcgcgccctttcgtgcttataccagaaaggcgccggcgcggccctgccgcccgtgcggcgtctgcagccgcctgccgatgcgaatacaatgccccgatccccgccgccgcccccacctgccggagccgtcatgttcgacctgaccacgctgaccaccttcacggccgtcgtcctgggcctgttcctgattcccggccccgccgtgctgctcgtgctgagccgcaccgtgcagggcggccgcaagaccggcatcctgaccggcctcggcgtcgccagcggcgacttcgtgcatacgctgttcgcggccgtcggcctgtcggcgctgctgatgacgtcggcgctcgcgttcaatgtcgtgaaggtgatcggcgccgcgtacctgatctatctcggcgtgcgcgcgctgctggagaagccgtccgatccgtcgctgccgagcgtatcgcccgtcaccccgctcaaggcgtacctgcaggcgattcccgccgaggtgctgaatccgaagacggcgctgttcttcctcgcgttcatgccgcaattcgtgcatccggaacgcggctcgacgttcgtgcagttcgcggtgctcgggctgatcttcgtcgtgctcagctcgctctacacgacgctgatcgcctgctcgatccgtccgctcggccgcatcgtgaagcggctcacgtggctcacgcgctggcaggggaagatcatcggctcgatcttcatcgcgctcgggctgcgcgtggccgtgcagcagcgctgacacgcacggccgcatgacgtccgccgccacgcccgccggcgaagcgctctacaccgacccgcgcctcgtcgcggtctacgacctgttcaacgcgggcgatcgggatttcgcgttctacgcgtccgtgatcggcgccgcacgccgacgcatcctcgacctcggctgcggcaccggcacgttcgcgcgccggctcgcggcagccgggcacgacgtcgtggcgatcgatcccgcgccggcgatgatcgaatacgcccgacgccagccgggcgccgacgcggtccactggcttgcgtgcgggctggacggcctgccgcccgacgcgccgccgttcgacgcggtcgtgatgaccgggcatgcgttccagtgcctgctaaccgacgccgaaatcgatacgacgctgcgcggcgcgcggcgcgtgctcgccgacggcggccgcttcctgttcgagacccgcaatccgcgcatcgcgccgtggcgtgcatggacgccggcacattcggcacgcagcgtcgaatcgcgcgaatcgggcatcgtcgacctgcatcatgcggtgcgctccgtggacggcgcgatcgtcacgttcgacacgcactaccgcttccgccgcgacgacacggtgctgacgaacacgagccggctgcgcttcatcactcaacccgacttgcgggagcgcgtgatcgcggccggattctcgtcggccgagtggtacggcgactggcagcacgcaccgttcgacgctgcgaccagcgcggagatcatcgcgatctgccgcgcgtgagtgcgcgttcccggtcgcgtcagcccgccaccggcagcgtgtccaccgcatacacatgccgcagcgtgcggcccagcaccggatcgtccagctcgacctcgaaccgctcggccggccggatgccgccgatcgccgccagcgtgccgcacagcatcgcggtgccgtcgacgaagcggccgtcgtggcgtgcgaactgcgcgagcaggtcgtccggtgcccgcatcgtgctcaccttgccttcctggtacagcacgcgctcgccgtcgatcgtcgcgtaggcgcgcagcacgagctgatcccagtgcccggccacgtcgtcgagcttccacagcgtgttcgcgcacggcttgccgcacatctgcttcgacaccgtgatcccgtacgtctcgacctcgcggtcggtgtgatcggacgcgatgccgacgaacgtctcgccgccgtcgcgcaccagcacgaattccgcttcgccgctgctctgcccgcccgacacctggattgcgggcgacggatcgaggcggtcggccgcgacgcggtagaacacgggcgtcgtcgccggacgcttgacgccgagttcctccagctcgcgggtgtgcttctccatggcggccgtgtcgcggccggtccagcccgcgatcacgagcgtgtcgatcgcgatcgcacgctcggtgcggccgtcgcgaccgtcgatcgcaaacgtgatggttttcatcgaatgctcctcgtagcgggcagcgcacgcgcgatgcggcgccgcccgcgatgtgtcgtgaatggccgggctcaggccgggtcgtagtagtgaatctccagcagcacgcagccgccgttcgacttgaacgggccgtgccatgcgccgggcgggcgcaccgcatacgtgtagcccttgaacggcgtgccgccgttgccgtgttcgtcgttgccgacggtcaggtcgccttcgacgagaaacacctcttcccagtagtcgtgcacgaacggcttcttcgtatgcagcccggccggcaggcgcagcaggcgcgtgcggctgccgcgcttccgctcggtgtcgagcgcgccggacaggatcagttcctgcgcgccggaggccgggtcatagccttccggcagttgccagtcgcgctgcatgtccagcgtatggaattcgtcgtgaagcttgttgatggccatctgtctctcctgtggcgatagcggatgagtcgaacgcgacgcggcgcgtcaggcggcgcgcggcgtcgacaattcctggttcagcgaatagctgccgagcatcgaatcgacgagatgcgacgcgcgctgccagtcgtacgtgcgatacgcatgccccttcgtgacgaacgacgcgccggcgtagaacagttcgtactggttgtggcgcgacgcgaattcggagccgaccgcatcccacgcgagcttgaagaacttcacgcgctcctcggacgagcacaccggcgacttctgcgtcttctcgatgatgcgcagcaggtcggggttctcgaaatcgcgcgcgctggacggcagcatgatcattccgccgccggcgagctcgcgcagcgtgttgagcaccttcgaatagagctgctgcgtgacgacctgcgagccgtacagcatgttgcgatcgggcacgtagaagccgttgacgacggtgcccttcgcttccatcccgtagacccacgcctcgaccatcgacgcttcggccgcgagctggcccagcgtttcgcgcacctgcgggaacgcattcgtgccgttgacctcggagatcttcaggccgagcccgacgaggaagcgcagcttcgtcatcaggcgcacctggcattggtagttctggtacacgtgcgcgggcgtcgcgtggaactgcttcgcgcacatcgccgtgttgccggcaacgaagatccgttcccacggcaccttcacgtcgtcgaaatacagcaccgcgtcgttctcgtcgaagcggctcgacagcgggttgtcgaacaccgatgtcgcgttctcctcgtacgacttgcgcgacaggatcttcatccccttcgcgttcatcggcaccgcgaacgacagcgcatacatctcgtcgccctcgcgcagcggctggatgcagctgcagaacacctcgttcgccatgattccgctcgtcgcgagcatcttcgcgccgcgcaccgtgatgccttcggcatcctgatcgacgatgccgaccgcgaggtacttgtcctcctgctcgtgcgcggctttcgactggttcgcctgcggattcacgatcacgtaggtcaggaacaggtcgttgtcgcgtgcgtagcggtagtagtcgcgcagcgcgcccgcccgcgccggatcgtattgctcgaacacgtcggcgcccatcaccatgccggcaagacaggacgcgacgtgatccggcgagcggcccatgaagccgtaatgcagttccgaccacgcttccagcgcggcacggcgttcgacgagttcgtcgtaggaggtcggcagttgccagatccggctgacgcggttgcccgagtcgggcgacacgaacgtcatcttctcgacgttctcgtcgcgcgcctggtagtcgtacaggctcgcgtagctgcggatcgaattgcggaatgccgcatgcgcggtcacgtcgccgaccggctggccgttcaggtagacctgccgcccgtcgcgcagcgacgcgatgtgctgggttccgttcttgatcatgatgtcctcctgggtggaatgaaacgtggattgcattcaggcagacggcgcgtgcatgccgtcgagcgtgcgatagcggccgccgaagaagatcagcgggcgcccttccgagcgcgcgcggtgccgcgtcacgcggccgacgaagatcacgtgatcgccgccgtcgtactgcgcgtagggctcgcattcgaacgtcgcgagcgcgtcgggcagcagcaccgcgccgtcgtcatcggccgcgccggcacgccagccccacttgtcgccgttcgctttcgcgaagcagttcgacaggtgctgttgcgtctcgtcgagcacgttgaccgcatagccgcccgcgccggccaggtcgccgaggctcaggctccgacggtcgaccgaaaacaggatcagcggcgggtccagcgacaccgaattgaacgacgcgaccgtgataccgatcggcgccccctccttgcgcggggcggtaatcaccgcgacgcccgtcgcgaacatcgacagcgcggcgcgaaagcgccgctgcgcgtcggcacccgcaccggttccggcatggttctcgctcatctcgtcctccttgttgcatcgcctgattccgctgcggaatccggcccaacaaagcaccgttacttagctttgttatttagctttattaaatgcaaacacaaaggcgggttcaagttgtcgtaaaccctgacctagaaagctttgtttgaaagacaaccctactggcgggatggatgttgcgcggcgcccgcgaatgtccacgtacactgcggctaccctgttccgcggtgctttcgcgcaccgcgggagacaccgctttccggagccgcatcgatgcaatcccgtccgatccacatggactacagcgcgacgacgcccgtcgatccgcgcgtggtcgacaaaatggtgccgttcctgcacgagcagttcggcaacccggcttcacgcagccacagctacggctgggatgccgagcaggcggtcgaggaggcgcgcgcccacgtcgccgcgctgctcggcgccgatccgcgcgaaatcgtgtggacctccggcgcgaccgagggcaacaacctcgcgatcaagggcgccgcgcacttctaccagggcaagggcaggcatctcgtcacggtgaagaccgagcacaaggccgtgctcgatacgtgccgcgagctcgaacgccagggcttcgacgtcacgtacctcgacgtgcgggaagacggcctgctcgatctcgacacggtgcggcaggcgctgcgcgccgacacgatcctggtgtcagtgatgctcgcgaacaatgaaacgggcgtgatccagccggtgacggagatcggcgcgctgtgccgcgcgcgcggcatcgtgttccactgcgacgccgtgcaggcggccggcaagatcccggtcgacgtgaatgcgttgaacgtcgacctgctgacggtgaccgcgcacaaggtctacggcccgaaggggatcggcgcgctgtacgtgcgccgcaagccgcgcgtgcggatcgaagcgcagatgcacggcggcggccatgagcgcgggatgcgctcgggcacgctgcccacccaccagatcgtcgggatgggcgaggcgttccggctcgcgaaggaagagatggcggaggaaagccgccgcgtcggcgtattgcgcgaccggttgctggccggcctgtcgacgctcgacgaggtttacgtgaacggcgatctggcccgccggattccgcacaacctgaacgtcagcttcaatttcgtcgaaggcgaatcgctgatcatggggatcaagggtgtcgcggtatcgtcaggctccgcgtgcacgtcggcatcgctggagccgtcgtacgtgctgcgcgcgctgggccgcagcgacgagctcgcgcacagctcgatccgcttcacgctcggccgcttcacgaccgaagccgaagtggacagcgtgattgcgcaggtgcgcgacactgtcggcaagctgcgcgcgctgagcccgctgtgggacatgcatctcgaaggggtcgacctgaatacgatcgagtgggccgcgcactgagtgcggccgaagcgtcaggcgggccggcggcgcgtgcgcgtcagcctttttcctggcgcgcgatcaggtgcgcgagatcgagcgtcgcgcggtcgccgttggtgacgaggcggtcgatcaccgagcagagcgccttgaattcggtcttcgtcacgccctcgaacagcacgttgttgatgcgctgctgcgtatcggtgagcgccttcagcagcttcgagccggccggcgtgaccgtgagacgcatcttgcgcttgtcgtcggggtccgggcgtttgtcgatcaggccgagcttcttcagcttgcccgtctcgatcgtgacgaatgcgccgctcaggtgcaggtgatcggcgaggcggttgacggtcacgacgtcgtcgtgcgaaagatgcgaaaccgatacgagcagcgaatactggatgccggtgaggccgaccagcgagccgaagccgtcgcgtaccgacagcaggcgcgccgcaaacggcagcagcccgttgatcaggtggcgaaattccgtgtccgtgccgtcgatcaggcaggccgggttggtgatggtcagaacggactcctcttgctgcttggccatgacttcgacgctccgtacggtcatgcgaatttagctttgaaacgaaattatacggcaaaggcacatgcgcccctggccaggtcgggccggtgcgcgtggcctcatttcccgctacaggaggctcgtccatgcccttcccgcttcatcccgcgtcggttcgcgcgctgctcgaatgctatctgcgcgcaaaggacctgaaccggcccgcgctgatcgccgactgtttcgcggccgatgccgagctgagcttttcgctcgcgaacgacgacatcgattttccgccgcgcgtgacgggcgcggccgcgatcgcacgcaccctggtcgaggaattcggcgagcggttcgagcggtgccggacctattacgtttgcacggagcccgaagtcgacccacatggacatggcgtcagcgagatgtcgtggctcgtcgtgatgcggcagaaggacaacggcgcgttgcggatcgggcacggcacgtaccgctggcagttcacacccgacagcgaaggcggtgcgcggatcgccgcgctgcacattcacatcgcgcgcatggatacgatcgacgatccgaagtcgacgaaactcgacgcgctgcacgcggcgttcgggtatccgtggctgccggcgcacgcgttcgcgcgcgggctggcggatgtcgcggccgcgcagccggaatgggcattcctggcgtcgtttcacgaggcggcggcagcggcggccggttgaaacacggccgaagcgcgtcgccgcatcacgtgcgggcaaggagctgacggaccgtcatcacgcgcggatcgtcgatcgtcagaacctcgccgtaatgggcaatcgttgcacggcggtcgagcaacagcggaatcgagacgcgcccgagcagcgtccgctcgaccgcttcgccgaacgtgaatccgcacagatgcacaccatcgaccacgcaattggtcgagaacactcggccctgcgcatcgacataaaactcggcgtatccgagatcgtcttcggcgaagccgatcatcgtcgtcccgagcgcctgttcccacgcgtcgatctggtgatccttgcgcgccagcgcatgaaagacgagccccattcgcgcgcaggtttgcccgctggcagaggcgcccacgatcagcccgccgaattcgcgcaggattgcatctcccggatgctcgccgtcgccggatgacacacggcaaccggaatcgccacgccaccccgaatcggcaaacagcgctttgaccgacgaaggaatcacgaccaccaccaccctcccgacgtttgcgtgcacgataccgcacgcgctatccgccatgcgcgacgcagggaatgcatcgcgcatgcccgtcacctcgacgcatcgagcgcgccctcacccctcccaatccagcccgaaccgcgcgagatacttgcgcagcctgtccgcatcgttcggctgcttcttgctctgccgcgacaccgcgaacagcgtgcgccccgcttccgacaggcttgccgacacgcggcacacgtcgagcacgcgttcgagctgcgcacggtcgaacaggtcgagttccgccgcacgcgcgccgaacaccgcgtcgacgcatgcctcggacgatcccgcgccgcccggctgcgaccacgtgcgcgtcagccgctcgacttcctgttcggcaagcgcttcggtaatccgtcccgcatcggccagcgtcgccatccgcgtgaccgacgcggacagctcgcggaagttgccggcccacgccgcacgcggcgacgcggcgaacgcgaggtagcgccgcttcgcctcgacgttgaaacgcacctgctcgccctgctcgcggccgaaccggtcgagttcgaattcgaggttcggctcgatgtcctcgcggcgctcggccagccccggcagctcgtacgtccacaggttgatccgcgcatagagatcctcgcggaaggtgccggccgccaccatctgccgcaggtcgcggtgcgtgcccgcgatcagttcgaaatcgctggtcgcctcgacgtccgcgccgaccggcaggaaacgcttctcctcgatcgccttcagcagcatcgcctgttcgtcgagcccgagttcgccgatctcgtcgagaaacagcaggccgccgtccgccgcgcgcagcagcccggcccgcgccgactgcgcgcccgtgaacgcgcccttcacgtggccgaacagcgtcgacatcgccgcgtcgccgcgcagcgtcgcgcagttgatctcgatgaacggccccgcgagccgatgccggccgcgtttcagctcgtacacgcgcttcgcgagaaacgacttgccggcgcccgtcggcccgaccagcagcatcggcgcgcgcgaacgcacggccacgcgctccagttgctcgatcagcgcattgaagcgcgcgttgcgcgtcgcgatgccggccttcaggaacgacaccgtctcgtcgcgctcgcgcgtgaagcgctgcgcgatccggttgtagcgcgacaggtcgagatcgatcaccgacatcgtgccgggcccgctcggcccctcgtcggtcttctgcggcggtgccgtctgggcaagacgcgccggcaggtagcgcgcctccgccagcaggaaccagcagatctgcgcgacgtgcgtgccggtggtgatgtggatcaggtagtcctcgcggtcgagatcgaacgggtaggcgcgcgcgaaatcgtgcagggtcgcgtagacctcctcgaaatcccacggatcgcgaatctccatcggaacgagccgcacgtcggtgtgcggcgacacgcgctccaggtcctgcttcacacggttcgcgagacgcgcgtagttcggcgcgtgcagcagttcgagccggtcgaccggcatgtcgcgctgctcgcacagcgaaatcgtcggccgccagttgcgccagcgacgctgcgagccgccgccctggtcgagcacggtaccgagaaaaccgatcgcgacggtcttgcgcatgtttatcccacaagataagaggcgatccgattgtatcgaatattcggatcgagccgtggcaggattttcatgcgccgcccgtcacgacaaataatttcccttccatttcaacgacttgggatttatttcgtgcatcacgccgcccgctggcacgctcctcgctaaatagaaagcgccggatgtcccgctggcccgcgagccagggttcacaaagccctgctggtgcgccgccgccgaacctggttcgtcgcggtcgcgcatgccgccatgggcagacgaaggcaaacgggcgcgtactggaacttcgcccgggttcgaatcccgggcgccctccgttcggtagctcattcgggtagagcagccggcgcaagccggtgtgtagcgggttcgaatcccgctcgaacgctgtccgcaaggacagccttgtaatgaaagcagtacccgccggtgcgggccgcaaggcccgccgcgcgtcggaccggttgcggttccgcgcgatcggccggacggccgcacggcccgcgcgaaggcgcacgacgacgcgaagcaggatgcgtcgccgcgcacttcggcgccgggcctgcgcgccgcccgcccggttgcgtcgccccgcgatccgcacgatgcgcgtcacccggcggtcatcgaagaaaaggacaagaatatgtggatgcgacatgtagtgaaaaagaacgaacgcgcgctgctgatgaacgagggcgatttcgtgaaggtgctcgaaccgggcgtgttcaaggccttcgatccgttcaagcgcctgtcggtgcagaccgcgcgtctcgacgcgccgctcgccgatgcggcactggccgattacctgcgtcacgacgcacaggacgtgctcgcccggcacttcgtcgcgatggatctcgccgacgacgaagccggcctgcgctacgaagacgacgtgctcgtcgagatcctggcgcccggcacgcgccggctgtactggcgcggcctgaccgcgcaccgtctcgagcgcgtcgatctcgcgcaggacagcatgctgccggccgcgctcgtgaagcgcatcgcgcaaccggcgctgcgggcgcgcggcgtggcgggcctggcgggcgtactgctggcgcaggtgccggcgtaccacgtcggcgtgctgaagatcgacggcaagatcgagcggctgctggacgcgggcgtctcggcgttctggcgcttcaaccgcgacatcgcggtcgaactcgtcgatctgcgcgtgcaggcgctcgaagtcggcggacaggaaatcctgacgcgcgacaaggtcgcgctgcggttgaacctgtcggcgacgtggtgttatgcggacgtgctgcatgcgttcggccagctgcaaaagccggtcgagcacctgtatcgcgagctgcagttcgccctgcgctcggccgtcggcacgcgctcgctcgacgaactgctggaagacaagcagtcgatcgacgacgtcgtgatcacgcaggtgcgtgcacgcctgggcaactcgggcgtggacgtgcgcagcgtcggcgtgaaggatatcgtgctgccgggcgacatgaagacgatcctcgcgcaggtggtcgaggcggagaagtccgcgcaagcgaacgtgattcgccgccgcgaggaaacggcggccacgcgttcgctgctgaacaccgcgaaggtgatggaagaaaacccgaccgcgctgcggctcaaggagctggaaacgctcgagcgcgtcgcggaacggatcgaccgcatctcggtgttcggcggtctcgaccaggtgctgaacggactcgtcagcatcaagggcgcctgacgggcgcaacggcgcggcgcaagtgtgccgcgccgcatgaatgaaggaatcaggtgaagcaaatgagtgcaatggattaccaggtgatggaactggcgaacggcaagccggtgaagatgtggacgcaaggcgtcgccgtcgaggacgaagcgcgcgcgcagttgcgcaacaccgcgcagatgccgttcatcttccgccacgtcgcggtgatgccggacgtccacctcggcaagggctcgacgatcggcagcgtgatcccgacgaagggcgcgatcattccggccgcggtcggcgtcgacatcggctgcgggatgatggccgcgcgcacgacgctgacggcagccgacctgccggattcgctcgcgggcctgcgcagtgcgatcgaacgcgcggtgccgcacggccgcgcgccgggccgccgcgatccgggcgcgtggggcgaccgcacgccggccgccgtgaccgaatcgtggaagtcgctgcaaccgggcttccagcggatcgtcgacaagtatccgaagctggaaaagacgaaccactacgcgcatctcggcacgctcggcaccggcaaccacttcatcgaagtgtgcgtcgacgaagcggaccacgtgtggttcatgctgcacagcggctcgcgcggcgtcggcaatgcgatcggcagcctgttcatcgaactcgcgcaggccgacatgcggcagcacatcgcgaacctgccggatcgcaacctcgcgtatttcaccgagggcagccgccacttcgacgactacgtcgaggcggtcggctgggcgcaggactacgcgcggcgcaaccggcaggcgatgatggatgcggtgatcggcgcggcgcgcggcgtgatcgcgaagccgttctcggtcgacgaacacgcggtgaactgccaccacaactacgtgcagcgcgaacgccatttcggcgaagacgtgctcgtgacgcgcaagggtgcggtgtccgcgcagaaggggcagctcgggatcattccgggctcgatgggtgcgaaaagcttcatcgtgcgcgggctcggcaacccggaaagcttctgctcgtgcagccacggcgcgggccggacgatgagccgcaccgaagcgaagcgccgcttcacggtcgacgaccaggtgaaggcgacccagggcgtcgaatgccggaaggactcgggcgtcgtcgacgaaatcccgatggcctacaaggacatcgacgcggtgatggcggcccagcgcagcctcgtcgaagtggtgcatacgctgcgccaggtggtgtgcgtgaaaggatagcgcggtgcgcggccgatggccggcggccgcgcgcaacgagagagaaacgacaatcatgaaaacggaacaactgactgccgtgcgcagtgcgcacccggtcgacccggccgtgcgggcgcgcgtgatggcggagctcgcggaagtcgagcgccgtcacgacgtgagcgtgctgttcgcgtgcgaatcgggcagccgcggctggggttcgcctcgccggacagcgactacgacgtgcgcttcgtgtatgcgcaccggcgcgactggtacctgagcgtcgaagcgcaacgcgacgtgatcgagcggccgctcgacgacgagctggacgtcagcggctgggaactgcgcaaggcgctgcaactgctgcgccgctcgaacccgacgctgctcgaatggctcgactcgcccgtcgtgtatcgcgaagacgcgcgctgggcgccgcggctcaggtcgctggcgtcggcgttcttctcgccggtgcgcgggcgtcatcactacctcgcgatggcgaagaagaactttcgcggctatctgcaaggcgacacggtgcgctacaagaaatacctgtacgtgctgcggccgctgctcgcggtgcggtggatcgacgcggggctcgggatgccgccgatgcgtttcgcggcgctcgtcgacggcaccgtgcacgagccgtcggtgcgcgcggagctcgacgcgctgctcgcgctgaagatgagcgcgaacgaaagcgaatacgggccgcgccggccggcgatccacgcgctcgtcgagacgatgctcgccgatgccgaacacgatcgcgaatacaagcggccgtggggcgacgtggcgatgctcgacgcgttcctgcgcgacgtggtcgacgcacgatgaaagcgaacggcgcgatgcctgcgggcatcgcgccgtttgcgcattcgtgcacgtgcgccccgtgccggccagcaacgtacgtgcccccacacgacgcgccgccgccgcgatcggcgcccattgcggcggtactcgaaaccgttccgcaaagcgcgcccctgcatgcgccgctgccttcgaccgccccgcttgctgacgatgcgcttgcagtccgacgtcttgcgcccgcccatccacagtcgatacgaaccgtcatgtcgcaccgcctttcgctcgccatcgccgccctcctcgccgtttcccgatcgttgcccaggcccgtccgctcacgcggccgccggtcgagcgcgacttcaagaactggtcggtcgtctgcgacaacgtcaatcgttgcattgccgaaagccatgccgacgacatcgacgactcgcgcaccagcctcatcctgcgcgtgacgcgcgatgccggcccggacgcgcaagcctcgctcgccctctattcgtcggcgccgctggacctgcgcaccgcacgcgcggacggccgcccgttcgatgcgatggcggcccagtggcatgcgttcggcggcaaaccggacgacgacgaagcacacccgttccggattcgcaccgacgatccggcaacggttgccgcatggctcaccgcggcgcgcaacgcgcaactgctgagcttcggcgatcccgcgtcggcgcaaaccgcccggacgccgttgacggggttgaacgccgcgctgctgctgatcgacgacacgcagggccgggtcggcacgacgacggcgctgctgcgccccggcaaccggcccgcgtcgtcggtgccggccgcgccggcactgccgcccgccgtcgtgccggcgccggccgtcgcggacctgccggccggcgggcagcgcccgctcgtcgacgcggtgctcgcgaagttcggcgacgacatcaaacaatgcgcggccgacgtcgaagacgaaatgtcggccagcgatcgccggaaggcgtcgcgcgccgtggcgatctccgccgacgaggcgctcgtcgcgataccgtgccagaccagcagcatgtataaccgcaccgacctgtggtatcgcgtgcgaaggacggcaccgttcacgccgacggcgatgaatttcggcgagaacgcgaacgcggggctcgactcggcgtcgttcgcgaacgaactgacggaggccggctacgaccgcacccgcgcgacgctgtcgagcaaggtcaggctgcgcagcgccggcgattgcggctcgaccgcgtcgtggatcttcgacggccggcgcttcctgctcagcgacatcgccacgcacggcacgtgcaacggcctttcgacgatcaatggccacgcctgtatcgacgcgccgatgcgccaggaaaccgctgacgcgtgcatcgcaccgcaacacgccggcagtcacacccataacaaaccgaggggccgacccatgcatctcccgttcatcgacgcgtcgcgcaacgcgaccgcgacgcggcgcacgcgcggctggcgtgccgcaattgcgttcgcgctgctcgtcgtcaccgcgttcgccttttcgccaatgagtgcggcacgcgcggcaagcgccgacgatacagtcgagatcccgttctggtcgcgcgactgggtcggtacgatcggcaaccggcatgtcgaagtctcgctgtcgcgcgtggccggcacggtatcgggctcgtactgctacgcgccctgcacgtccgacaaacgctaccggctcgcgctgaaggggacgctcgacgcgcacggcgccacgctgtcggaacgcgacagcggcgcgaaaaccgacgccaatcgcgtaacgggcacgtggcgcgtggcatcgctcgacaatgcggtagccggcacgtgggcgtcgccggacggcaaacgctcgctgcccgtctcgctcgcaacgaaacaggacggcaggccgttcccttacgagatccgcctcgtcgcggacaagctgccggacgacgacggttcgtgcaacgacccgccgcacgtcaccgcgatccgcctgtacgatcgcggccgcctcgtgcagacgctgcagaccgattcacgcggcacctgcggcctgttcacgcccgatttcgccgacgtgaatttcgacggctggcccgacctgatgctcgcgcaatcgatgggcgcgggcccgaacattccgtaccagacgtggatcttcgacccgaagacgcggcgcttcgtcgacgcgccgcaggggctgcaaggcatcacgtcgccggagttcgatgccgtgcaccggatcatctggacgagctggcgcgcgagctgctgcgagcatggcgtgacgacctaccgctggcagggcaacgacgtgaaggaggccgactccgccagcagctacctgctgccggtgctcgacgggaacacgcgccgctattgctacgtcacacccggctacggcgacggctacatcgagtttccgcagcgcatcgagcagaccggcacggggctgcgctcgacgctgggcgcgctgaaagactgcgaggtggacgcgtcaccgtggatggcgcgcgtgtacatcgacatctggaagccgggcgcgcccggccacgcgccgacgctcgtccgcacccaaaggtcgcgtggaagcgcacgtcgacccgcgccggcatgaagttctgccccgacgtgccgttctacgacaacggccgcatccgccgcatcgtgctgcgcgacgatcccgaccagtgcaacgacaggaatcccgaccagaactagcgcgcgggtcgaccgcacgcgcgtgccgccctcacgtcacgcgccgacgatcgagatcgagaacccgtcccagcccttctgcccgaccgtctgcacggccgtcgtggtgacgtgcggcgcggccgcgagacgcgcgaacccgtcgcgcacgccggccacgtcaggctcgcgattgtcgggatcggccacccgcccgccgcgcacgacgttgtcgacgacgatcaccgtgccgggccgcgacagcttcagcgccgcgtcgagatagaccgggttgttgtccttgtcggcatcgatgaagatgaaatcgaacggcgcttcgcctgcgtcgacgagccgcgcgaggctgtccttcgcgctgccgaccaccaccgtcacgacctccgcgaacccggcacgcgcgatgttccgcgtcgcgaccttcgcatgttcgggattcagctcgagcgtcacgagcgtgccgcccggcggcaatgcgcgcgcgagccagatcgtgctgtagccgccgagcgtgccgacctcgaggatccgccgcgcgccgcgaatcgtcgcgagcagttgcagcagcttgccctggttcggcgcgacgttgatcgcgggcagcccggccgcgtcgctcgccgccagcgcggcgtcgagcgcgtcgtcggacggcacgagcgtcgcggagaaatacgcatccacctggttccagtgatcctgattcatcgcgcaccccttgtttgcggaaagggcattctatgcgccgcaccgccataagcaacaaaccattcgttctaagggccgccgcgcacgtgctcctataatcgctcgaccaccacaacaacagacggagcacccatgaccgatcaggcctcttcgaactggcgcctcgaaaccatcgccgtgcacggcggttatcgtcccgacccgaccacgcgcgcggtcgccgtaccgatctaccagaccgttgcgtacgcattcgacgacacgcagcacggcgccgacctgttcgacctgaaggtgcagggcaacatctacacgcggatcatgaacccgacgacggacgtactcgagcagcgtatcgccgcgctcgagggcggcatcggcgcgctcgcgctcgcatcgggacaatcggccgtcacgtacgcgatccagacgatcgccgaggccggcgacaacatcgtgtccgcgagttcgctgtacggcggcacctacaacctgttcgcgcatacgctgccgcaatacgggatcacgacgcgtttcgccgatcctcgcgaccccgcgtcgttcgagccgctgatcgacgcgcgcacgaaggcgatcttcgcggaatcggtcggcaacccgctcggcaacgtcaccgacatcgccgcgctcgcggaagtcgcgcatcgccacggcatcccgctgatcgtcgacaacacggtgccgtcgccgtatctgctgcgcccgttcgagcacggcgcggacatcgtcgtgcattcgctgacgaagtatctcggcgggcacggcacgagcctgggcggcgcgatcgtcgattcgggcaagttcccgtgggccgagcatgcggaccgcttcaagcggctgaacgagcccgacgtcagctatcacggcgtcgtctacacggaagcgttcgggccggccgcctatatcggccgcgcgcgcgtggtgccgctgcgcaacatgggcgcggccatctcgccgttcaatgccttccagatcctgcagggcatcgaaacgctggcgctgcgcgtcgagcggatcagcgacaacgcgctgaagatcgcgcagcatctcgcgcgtcacgagcaggtcgaatgggtgaactatgcgggcctgcccgatcaccccgaccatccgctcgtcgcgcgctacctgtcgggccgtgcgccgggcatcctgacgttcggcgtgaagggcggccgcgacggcggagcgaagttccaggacgcgctgaagctgttcacgcggctcgtcaacatcggcgacacgaaatcgctcgcgacgcacccggcatcgacgacgcaccggcaactgtcgccggccgaactcgcgaaggccggcgtgaaggaagaaacggtgcggctgtcgatcggcatcgaacatatcgacgacctgctcgccgatctcgaccaggcgctcgcgcaggtgtgaccggcacgggcgcgccggcttgccggtgcgccctgcatcgaatgtgttgaccttgaagcggcttcagggtgttcaatccccggttgatgccggggcagcgcccggcgtgcatgaaccgtaccctgcggccgggcagccggatgccgagcccgctgcggtacgccaaccgttcgagaggcctcatgacaccgaccgcgaagcttgcgctactgacgttaccgcccgtgctggcggcctgtttcggcgcactcgccgccgcgtggcgcgccccggcccgacaacgtcgagcgtcatccagcatttcaccggcggcatcgtgttcgcggccgcggcgctcgaactgctgccgcaagatcgcgcgcatgcgctgtttccggtcgtcgtcggcttcgtgctcggcatcgcgctgatgctcgcgatccgtgcgctgtccggcgcgatcgagacgcgcttcgaggacgcgcggctgcccgtgagcctcgtcatcgtcaccgcgatcgacctcgtcatcgacggcctcgtgctcggcatcgccttctccgcgagcaccgaaagcggcatcatcctgaccgtcgcgctgacgctcgaggtgctgttcctcgcgctgtcggtcagcgccgcgctcgcggccgccggcattggccgcatgctgtcgatcgtcgtgccggtcgggctcgcggcactgctgagcgtcgcggccgttgccggcaacgcggcgttcgcagggcttcccgccaatatctacgcggcgctgctcgggctcggcaccgtcgcgctgctgtacctcgtcaccgaggagctgctggtcgaagcgcacgaggtacccgaaacgccgtttgcgacggccgcgttcttcatcggcttcatcgtgttcttcctgatcgaaggatcggtgaaggccggataagccggccgcggccgcgcgccggttaccacgtcgtcgcgcccgtcggatacgtgtcaacgatgcgcgtgccgttgaccggcgtcacgccttcgttgcgcagcgcggcccacaggtcgatcgcgtgttcgcgcgacttgcggctgccgtcgtcggtcagcacgttcagcgcgatcacctcgtcgcgggtcgtcagttgcagttgctccttcagcttgcgcgactgatgcgacgcggtgcggatatcgccgagcaggatccgcttctccgcgacatcctgcccgccgcctgcatcggccggcacgaacgtcagccgtccgcttccgacctcgcattgcccgcgcgtgaacgtcgcgctccactcgccggccggcacggtcgcgagctcgcaacgcatccgctcgttcgcgcggcggccgacctcgtgcgccggcgcgtgcgacagcgcgcgttccggccagccggccgccatcgcagccgtcgacatcaggcacgccgcgagcacgattcctttcgcgaaacggtgcatggcactctcctcttcgtgtggggtgcggccggcgggcaccgtgccggccggccgcgcatgaacgatcaacgaaccgcaaaacggatgtcgtgcgcatcgaccagcggcgccgcctcgccgcgatgtaccgtcgcgcgatggatttcctggttgcgcgcgacggtggccgggctcgccgggtagtcgtggttcgggctcgggatcacgccgtcgtggcgggcacgcaccagctcctgacggacttcctgacgggtcttctgctgcgcggccgctgcctgcgagatggccgcaatcgacaggacggcggcggcgacgatcatcggtcgcggaatgttcatgtggctcgctccttgcgggaaagatgtgacaggagccttcactttgatccggcggcggtgcgcaatcgtgatcgcagcatgacggtttcgtcactgccccggcctctcctgtatcgcactcccaatgaaaacgggtcgcaagtttccaggccgatgacgcggcgatgacattttctcatttgtccctcaccttcacgatccgaacgctttccagaatcggcagcgcgatcgcgacattccgcgcttgccgcaccaacgcgcggcgccggaatcgaccgatgcacggatcgatcctcttgaacctcagggacacaccatgaaaactccagttcggctcgcgatgatgtcgggtgcgatgctcacggccgcccacgcggcacacgcgtcggaagtcacgctgtacggcctgttcgatacgtcgttgacctacgtgtggaatgccgacgcgaacggcaggaatctcgtcggcctcggcaacggcaacctgctcggcaaccgcttcggcgtgaagggcgcggaagatctcggcggcgggctgaaagcggtcttcaccctggaaaacggcttcaacccgaacaccggcgcgctcgggcaaggcaaccggatgttcggccggcaggctttcgtgggcctcgaaagcgcgcgctggggcacgctgacgctcggccgtcagtacgacgcgctcgcggatgtcgcgtggccggtcaccggcgatttctacttcggcagcgtctatgcgacacccggcgacgtcgacaactacgacacgtcgtcgcgtaccgacaacgcggtgaaatacacgtcgccgctgatcaacggattccagttcgtcggcatgtacgcgctcggcggcgtggccggcaagagcggcgccgggcaaacctggtcggccggcctgtcgtacagcaacggcccggtcgacgtggccggcggctacttctacgccgccaatcgttcagcgctcgccaacggcatccgcaccggctggaacagcacctccgacggcacgttcgacgggtcgctggtcaacggcggctacctctccgcgaaatcgatcggcatcgcgcgcggcgcgttgcgctacagcttcgcgccgttcgcggtcggcatcgactacagcaacgcgcagtacaaggccgatgcgatgtccgcatttcggagcacgcagaagtacgacaccgcgcgcggcttcttcaactaccaggcgacacccagcctgctcgtcggcgtcggctacagctacacgcgcgcccgcggcgatacgggcgcgacttatcatcaggtgtccgccggcgccgattacgtgctgtcgaagcgcaccgatctctacgcggtcggtgcatggcagcgcgcgaacggcgaacagcgcacgctcgacggcggcacgcaaacggcgcaggcgtcgatcggctcctacggttatggcggtacgcgcacgcagggcatcgtcaatctcgggttgcgccaccggttctgatcgcggcggcaatacgcgcgccgcgtgacgaaaatttcatgttccgatcaggttcgcgaagcgtcgcatcgctacgatcgcaaacgtgacgggcagcgcccgttccagaccacgcaagcgggtcgctgccgcacggcacgtcacgcgttaggcccggactcgtcgagtgccgggcttcttttgctcgtcgtgaatcgacatcctgcttgttcggcgacgaacccgcgaccgaccgcgtgctatcccggacgactcccgccgcgtacctggcaacctgagagcgtgcaatcgcgtgccgtgcgatcgcggtcaacgcgtgccgctgcgctgcgggaacaggcacacgtgcgtcttgacgtacaggttcggattgccgcagcgatgcccggcatagtcgatctgctcgccgggtatgaggtcagccggcaccggcttgcgcgcggcgcccggcgtggtcgatgtggtcgatgtggtcgatgtggccgacgcagcgggcgttcggccggaacgcgtcgacgtacagcccgcgaacaacgggacgatcaggactgcgatcaaggcgaggcgaatggcgggacgaggcacttttcggtccggggtgaaagtcggaaagggccgcccgcattccgtgctgctgtcgcggacggcgtgaatgccgtcggccaggtcgaccatcggcagacttcatgttccgcttcccgctcatcgcgcccatgacgcgaacatgacgattgcatcatgtcggccgcggtcgaacggcacatccgtgcatcacgcaatctgacgcatttttcatctcgcgatcacgatcacgcatggctgctttcgcatactgggtccacggttcgccacccggcggccctgatcaaggagagcactcaatgaaaaccgcacaactcgcagcactgttcgtcaccgccacgctgtcgctcggcatggccacgcaggccgcgttcgcgcagacgcaaacgcagggcaagacccgcacgcaggtcgtcaatgaactgaagcaggcgcagcacgacggcgtcgtgccaacgagcaagacgcagtacccgccgagcagcgagctcatcgcgcgcaacaaggagcttcacgggatttcggtgcatggcggcgagaagaagccgcagaccgacaaccacgacgaactgaccgcgcggcaatgacgcccggccgcacgaccgcgggcagcgcgccacgcgcggccgcctcatggcgaacgcgcgggcgtgcccgcgcgcggtgtcaggcgccggcagccgccagccgcttcggctcggccggctggtgcggaaagcgcagccagaacgtcgtacgccggcccgggtcgctgtcgacgccgcattcgccgccgtgattgtccatgatcgaccggacgatcgcgaggcccagcccggtacccgacgccgaattgtgccgcgacggatcgacgcgatagaagcgctcgaaaatccgcccgacatgctcggcggcaatgccgggccccgtgtccgacacggcgatcgtcgtcgcaccgccctgctccacgcagtcgatcgtcacgacgctgccgcgcggcgcgtacctcagcgcattggacagcaggttgctcagcgcgcgctggtacagcgtcaggtccgcatcgacccacgcgtgaccgtcgaccttcacctgcacgcccgcatcttccgcgagcgcctcgtagtagccggccacacgcccggcctcctccgccgcattcaatcgccgcacgtcgatcgacgtgccggcctgttccgagcgcgcgagaaacagcatgtcctcgatcatccgcgacagccgctggtattcgtcgatgctcgactcgatcacgttccggtattcatccgcgctgcgcggctgcgacagcacgacctgtgcggccgcctgcaggttcgtgagcggcgtgcgcatgtcgtgcgcgagattcgacgagaactggctcagccgcgtgaacgattcgttcagccgcccgagcatcccgttgaacgcgtgttcgagctccttcagctcgcccgcggtatcgagttccggcaacggatgggcgagccggctcgtcgacatctgctcggcgcgcgccgcgaaccgcctcagcgggctcaagcccagcgccgcgatgccgtacgcgatcgcggccgcgagcaccacgccgaacacctcgatcacgacgatcgtataagcgtgcgtgcgcagcagcagcacgtcggcgctgcggtcgtactgcaccgccacgcgtaccaccggtgcgcccgcgccggcgagcggcacggtcgtcacgagatactgctgccgcgcgccgggcggcgcgacgccgaccggcacgcgccccgcgtcgagcgtcagcagcggtgcaaccaggcggaatccgggcgtgccgacgaggcgcgtgcccgccgcgtcgtagatcgcgagatccatgttcggatggccgtgcaactggtcgatccagatatcgacgttgcgcgtgacgtccgccgtcgagcgcgcttcggccaggtgcgcgcccagcgcggcggaaatcccggccatctgctcggcggccgtcgtttcgacgcgattgccgagcgcctcgtaaagcgcgaccccgctcgacgcgaggatcaccgacgtcgacaggatgatcagcgcggtcaggcgtccgcgcagcgtgcgcggcagcagtcgcgcgatcatgcggccgcgccgccgcgcgcttcgagcacgtagcccatcccgcgcacggtgtggatcagcttcgggtcgtacgcatcgtcgatcttcgagcgcaggcgccggatcgccgaatcgacgacgttcgtgtcgctgttgaaattcatgtcccacacctgcgacgcgatcgtcgcgcgcggcaggatttctccttcgcggcgcatcagcagccacagcagcgcgaattccttcgcggtcagcagtatcgtgtcgccctgccgcgtggccttgcggcgcgtcaggtcgagttcgaggtcggccacgcgcagcgtgttcgaatcgcgcggctggccgcgccgcaggatcgacttgatgcgcgcggtcagctcgacgaagtcgaacggcttcgcgagatagtcgtcggcgccgagctcgagccccttcacgcgatcgccgacatcgtcgcgcgcggtcaggaacagcaccggcgtcgacttgctgcgccgcaggttctgcagcagcgtccagccgtcctgcccgggcagcatcacgtcgagcacgagcaggtcgtattcctcggtctcggcctggtgctggcccgtgatgccgtcctcgacccagtcgacgacataacctgcttccgtcagccccttgcgcagatatgcgcccgtcttcggttcatcttcgacaatcagaattcgcatcacgcattacccttgaagaaacccagccagcgcagcacgcccgacacgaagccgccgccgaagccgcccgccagcgcggcacgccacgacaccgcatggctgacgcggtacagcacgggcagcaccagcagcgtcagcgccgtggacgacaggataccgccgatcacgaccgtcgcgagcgggcgctgcacctcggcgccggtgccggtcgcgaacgccatcggcaggaaaccgagcgacgcgacaagcgccgtcatcagcaccggccgcagccgcgtgagcgcgccttcgcgcacggcggcctcaagcggcgtcccgtcgtcgcgcaggttgcggatgaacgagatcatcacgagcccgttgagcacggccacgcccgacagcgcgatgaagccgaccgccgccgtgatcgacagcggaatcccgcgcagccacagcgacacgacgccgccgctcaacgcgaacggaatgccggtgaacacgagcagcccgtccttcacgttgttgaacatcacgaacagcagcacgaacaccatgaacagcgcgagcggcacgacgagcttcaggcgctcgctcgcactctgcagctgctcgaactgcccgccccacgacacccagtagccagccggcacgcgcacgtcctgctgaagctgctcgcgcgcgtcggcgacgaacgagccgacgtcgcgcccgcgcacgttcgcgctgacgaccacccgccgcttgccgtcctcgcggctgatctggttcgggccgggtgcgacgtcgatcgtcgcgagctccgcgagcggcacgtacggcgccgccgcgagcggcgcactggcgccggccgccggcgcgggcaatgcgatcggcagccgcttgatcgcctcgatgtccgagcgcagctcgtcgggcagccgcacgacgatgtcgaaacggcggtcgccctggaacagcgtgccggccttctgcccgccgacggccgcggccaccgtatcctgcaggtcggccacgctcacgccgtagcgcgcgagcttgtcgcggtcgagattgacggtcagcacgggcagccccgtggtctgctcgaccttcacttcggacgcgcccggcaccttctgcaatgccgccgcgatctgctcgccggtctgattcagcacggccatgtcgtcgccgaagatcttcacggcgacgtcgctgcgcacgcccgagatcagttcgttgaagcgcagctggatcggctgcgagaactcgtacgcgttgcccggcagctcggcgagcgcttcctcgatctcccgcacgagccggtcgcgcggcttcttcgggtcgggccaccggtcggcgggtttcagcatgatgtagccgtccgacaggttcggcggcatcgggtcggccgcgatctcggccgtgccggtgcgcgcgaacacacgctcgatctcgggaagcgcgccttcagcgtcttctcgatcgacttctgcatctcgaccgactgcgacaggctcgtgccgggaatccgcagcgcggcgaccgccaggtcgccttcgttcaggctcgggatgaactcgctgccgagccgcgtggcaagcccgagcgtgacgagcacgatcgcgcccgcgccgagcatcacgcgcaccggtcgcgtcatgaatgccgcgaggaccggctcgtatgcgcgccgcgcccagcccatcagccggttctccttctcctcgacgcgctcgccgatgaacagcgcgacggccgccggaatgaacgtgacggtcagcaccatcgcggctgcgagcgccatcacgacggtgatggccatcggatggaacatcttgccttcgacacccgtcagcgcaaagatcggcaggtacacgaccatgatgatcagttgcccgaagatcagcgcgcgccgcgcttcctgcgacgcgccgaacacttccgcgaagcgctcgtcgcgcgtgagcggccggccggcggcagcctgcgcatgcgcgagccgccgcacgcagttctcgacgatcaccaccgcgccgtcgacgatgatcccgaagtcgagcgcgccgaggctcatcaggttcgcgctcaccttcgcgttgaccattccggtgaaggtcatcagcatcgacagcgggatcacgagcgcggtgatcagcgccgcgcgcatgttgccgaggaacaggaacagcacggcgatcacgaggatcgcgccttcgagcaggttcttcttcaccgtcgcgacggccttctcgacgagcaccgtgcggtcgtacacgggaatcgccttcacgccggacggcagcgtgcggttcacgtccgccatcttcgcggcgacggccttcgcgaccgtgcggctgttctcgcccatcagcatgaagaccgtgccgagcacgacttcctcgccgttcgacgtcgcggcgccggtgcgcagttcgcggccgatgtcgacgacgccgacgtccttcatccgcaccggcacgccgccgacgttggtcagcacgatgttcgcgatgtcgtcgaccgtgcgcgcctggcccggcacgcgcacgagatactgctcgccgcgcttctcgatgtagccggcgccgacgttgtcgttgttgcgttcgagcgcgcgcacgacgtcggcgagcgtcagcccgtacgacatcagcttcgccggattcggtgcgacacggtactccttcacgtagccgccgatcgagttgacctcggtcacgccgcgcacgttccggagctgcggccgcacgacccagtcctgcagttcgcgcaggtcggccgccgtataacgcgtgccgtcgggcttgcgcgcggcggcatcggcctcgacggtccacaggtagatctcgccgagccccgtcgacgtcggccccatcgcgggcgcgatgccgggcggcagcttgtccttcgcttcctggatgcgctcgttgacgagttgccgcgcgaagtagatgtcggtgccgtccttgaagatcacggtgacctgcgacagcccgtagcgcgagatcgagcgcgtctgctcgaggcccggcagcccggccatcacggtctcgaccggataggtgatgcgctgctccgcctcgagcggcgaatagccgggcgcggccgtgttgatctggacctgcacgttggtgatgtcgggcaccgcgtcgatcggcagcttctggtagctgaacacgcccagtgcggccacggccgcgatcgccagcatcacgagccagcggtgcgcaatcgcaaagcggatcaggcgttcaaacatggcgggattccttgaagcggggcacggtcaccttcgacggacgggctgcccggccggccacccggcgggccgggaatctcgcagcgaaccgggccgcgaaccgggccgcagactgggccgcaaaccgggccgtgattcgcacaacggcgcacacgtgacgctcattcatgttccgcgctcccttgccgagttcggccttcagcacgaagctgttcgacgccgcgtattcctggcccggcttcagccccttcagcacttcggtcgcacgttcgtcgcgccgccccgtctcgacggcctgcgcgacgaagcccttcggtgaacgcacgaagacggacggtgcgccgtcgacgtcctgcagcgcgtcgctcgcgaccgcgagcggcacgccctgctttcccgcgtcgaccgacacgttcacgaacatcccgggccgccacacgccgtccgggttcggcaacacgacgcgcgcgggcgcggtgcgcgtctgttcgccgagcagcgaacccacgtacgcgatcgggccgctcgaacgcgattcgaacgcggtcgcgacgaccgtcgcgtcgcgtcccacccgcacgtcgttgagccgctgcgccggcacggccatctcggcccataccgtcgacaggtcggagatcacgaacatgctggcatcggcggcgatcgcttcgccgggcgtcgcatgcttctcgacgatcgtgcccgcgaacggcgcacgcagttcgtagcggttcagcgcgcccgcaccggcgggcgcattcagcgcggcgagcttctgccgtgcgttctgcacggcgatctcggcttcgcgcaactgcacctgcgcctgctggtagtcctgctcggccgaaatgcgctcctgccacagcgtgcgttcgcgctcgtaggtcgcgcgtgcgcccgacaaccggcgttcggccgtcagcagctcgctgcgccggtcggcgagatcggtgctcgcgatcacggccagcacctgccccttcgcgacgttctgcccgagcgacaccgacacctgctcgacgatgccggccacgcgcggcaccacgtgcgcggtgcgatcctcgttgaacttgatctcgccagggagctggaacggtgtcgcgatctgcgcggggccggccttcgcgagtgcgatcttcgaggtcgccagctgcgcgtcggtcaacacgatcgcgccgtcagcgcgtgcgaacgggaacgaggcggcgtcattgcccgccttcacgtcgatcgtcgcatcgaacacgtgcggcttggcgatcgactgcgcggacacgaacttccggccggccgcgtcgaaacgcaacggctcgtgcgtgcggtcgtaacggatcagcgtgccggacacggtgatgcccttgccggccggcttgccgtcgacgaacggatagacgacgaggcgcgcgtcgccgggcttctccgtcatcacgatttcgacggacagcttgccgcgcctgagcacgacaccgccgcgctcgccggcggcttcgttggatgaagcggcttcgggcgccgccgacgcggacgtgtcgttgccgccgccgttgcgcgtgacgccgagtgcgccgaggacgattccggcgctgccgagcacgaccgccgcgatgatcaggattctgctgcgtgacatgatgatccttcaggtaatggaggcgtctgtggcgctattgcgtgacagatacaagcggtgcaagcggcgtaccgacgagccggccgatgtcggcacgcgcggcatgggcgtcggcgagcgcgcgcacgtattgcgactggccctggaacagcgtgcgctgcgcgtcgagcacgtcgaggaagctgaacttcccgagttcgtagccgcgcgacatagcgtcgagcgcgacgcgcgcggccggcaggatgtcgtccttcagccgctgcgcttcctgcgcggcggcttcgaaattcgcgtaggcctgcgtgagttccagccgcaggcgcgtgcgttcgcgatcgagatcggcgttcgcccgagcggccttgtgcgtcgcctcgagcagcgcgcccttgttcgtgttgaacagcggaatcgggatcgacacgccgaccacggcctgattgtccggcacgccgcccgtggtcacgcgcttcacgcccgcgctgatcgtcacgtccggaatgcgccgcgcgcgttcgagcgatacggccgcgttcgagcgcagcatctcggcgcgcgcgatccgcgcgagcggcgcgtcgtcgagctgcgcggtgagcgcgggcagcgactcgaccggcggcacggcttcgaggtcgccgagcaccgccagcccgccgtcgcgcgcctcgcccatcaccgcgttcagcttctcgcgtgcgacctcgacacggccgcgcgccgtcacgacttcgatctgcacaccggccgccgccacgtgcgccttggtcgcctcgaccggcgacaccttgccggcctgtgcacggcggctcgcgagatccgcggagcgcgcggcgatcgcggccgattcctcggtgacctgaagctggcgctgcgcggcgagcagcccgtagaacgcggcgatcacgtcggcgcgcacgacggcgccctgttcgtcgagagacgcattggccgcttccctgccgtacgacgcgacgtcgagccgcgcgccgcgcttgccgccgagttcgatcgtctggttgatcagcgcggtcgacgtgcgttcggcgcgacggaagccttcctgcaggaacgacacttccggattggggcgcgcaccggcctgcatcagcgcgccggccgacgcatcgacgtccgcgcgtgcgccgcgcagcgccggattgttccggccgcggccgcgagcgcatcggcgagcgtcaacgaggtggaagggcgtgcgtcgggtggcggtgcgccgatcggcgcaccgccgccggaggcagccggagccggccccggcgacagcgacggctgcgcatgagccgtcgcggccatcgcgaagacgacggccgcggcgaggttgagcttgagcatgttcggttctgcggtaacggttcgcgaccgatgctacggtccggccgcagtgcgaacatgaggcgaagatgatatttccgtcatcttgggcgtggccgcgcgcaagcgtgctgtgccctgcgggaatggcatcccgcgtgaacgatcaggaagatcgggtgaacgtgcagcgcgacggctgcggggaagactgcggggatcggggtttcggcgcccgtgcgccgaaaccccggcacgcgaatcaggctgcccctttcgcgcgccggcgctgcacgagccagtcgagcaactgccgcccgtcgcgttcgccgaaccaccgcgcgtgcccgatcagatacccgtcgtatgcgatatcgacaatggccggcgcatcgatgatgcagccgaaatacgccacttccgacagcgcgaactccgtatgcacgatcggcagcatcgcgaccagcgccgcataggcttcgtcgcccagcggttcgagtgactcatacccgtcgagcagcgcgtcgatctgtgcgtactcgatgcggcgtgcctcggccggcgccatccagtcgaccgaattgcgctcgatcgcgagcgcgaggtccatgacggcgcacgtgcgatccgacagcccgaaatcgagcaccgtccgcacctgcgcgccgggccccgcctcggtccacagcaggttcgacgcgtgccagtcgccgtgcgtccacagcggcggcagcgccggcagcagcggcacgaggcgcgcgtgatacgggccgatcgcgtcggccacgtcgccgcgccagtcgcgcgcgccgagtgcgcgcacgagcagcggctgcgcctcgacccagcgttcgagcgcgcccgccagatcgtcggacgacagcacgcggaagctcgacagcagcgtgcgcacgggccgcgccggcgcatcgtagccggccgacgcgcgatgcagctcggccagcgcgcggccggccgcgtaagcgtgcgacgcatgcgtgaacggctgccacgacatcacgccgcgatacgggtcgacgccgggcgcgagcacatgcacttcgtaggtccagtcgccggacgcgaatgcggtcgcaccgttgcgatccgcgagcacgtcgaccaccggcatgccgcgttcgcgcaggtgcgcgatgaagcgatgctcttcctcgagccccgcgacatcgcgcaggctcgcgtgatgacgcttgacgaacagcccgcgcccgtccgccatccgcacgagcacggccgccgcgaactgtcgcgggctgtgccacgtgagccgctcgggctcgccggcgccgtcgatgcgcgcgagcaccgccgccacctcgtcgtgcgtcatcagcggccagtcgcgttcggcctgctcgccgtcgacaccgaattgcggcggcgcgacgtcacgcggcagggctccgtccggctcgagtgggaatgacatgaacgacgttgctccgtagttgaatcggcgcgtgaatcagcgcgcgcgccgccgccagcgcgcagcgccgcggccgtgcggctccagtcgcgccagccgacgacggccagcccgatgaacagcgcgtagaggccggccgtcagatacagttccttgaacacgaacatcccgacgtacacgacgttcacgacgatccacagcccccacgatgcgatgtagcgccgcgcggtccagtattgcgcgacgaggctgaacgcggtcagcgaggcatcgacgaacggcagcgccgcatcggtccagcgcgccatcatgccgccgagcagcgcgctgccgacgacggccgcgatcaggtcgggcagcatctgcatcggccgcacgcccgtgacgggcgcgacatcgcctgccggcgccgcattgccgtcggcctcgctcgcgcgctgcgcgagccagcgttgccagccgtacacctgcagcaccgcgaacgcgccttgcagcagcatgtccgaatacagcttcgcgtcgaagaagatccagccgtacaacgcaaccgacacgagcccggccggccagcacagcatgcgccgcttcgcggtcagccagatcgcgagcgcgctgacgatcacgccggcgatttcgagtgaggacatcgtctgtgctctccaggttagctgccggggccgcgggtcacgcggccggttccggacggtcagaaatcataggtcaacgacacgcgggcggtgcgcggcgcaccgggaacaggtacgcgtcgccctgctgctcgcccgcatcgcgccagtagaacttgttgaacaggttgtccaccgacacgcgcaacaccgtgcgatggccgccgatcttcgtcgtataacgcgcgccgagattgaacacgaaccacgccggcacctgcgcggtgccctcctcgttcgcgttgcgggccgcgctgtactcgacgccgcccagcacgttcagccccgcgacgcccggcaccgcgtagtccgcatacagcgatgcgcgcagcgcgggcacgttgatgatctggtggccttcgtacgccggcgaacccgaatcgtacgcccgcgcgcgaatcgccgcgacgctggccgtcagccccagacgctcggtcacgcgcccggccgcgccgagctcgatcccctggtgccgctgcgtgccgcgctgcacgaacgtgtaggtcgtgcccgatgcgtccggatcggcgaactggaacggcttgctgatcgagaacacggcggccgtgaggctcagccggtcgagccagtcgtatttcgcgccgacttcgatctggtgtgattcgaccggcggcaggaacgcatacgcgttggtcgcgcgcacgggtgcctggtcgccgagcgacagcgccttgctgtacgacgcgtacagcgacagcacgttcaccggcttgtagacgagcgcgacctgcggcaggaacaccgagtgatcggtgtgcgtcgcgtcgccgtcgaggctgctccagctgcgctggcgcagcagcacttccttgccgcccgcgagcacctgccagtgttcgccgatgctgatgcggtcgagcccgaacacgccgtattgccacgaatcgagctgcggatacgacggcccgggcgtattcggcgacggtgcgaacgtgacgtcgggtccgtagatgttctcgctgccgacatagtcgtacacggcggtcgccatgtgcacgacgcgacgctgcacgcttacgccgagcgtcagttcgtgccgcagcggccccgtcgcgaacttgccggtcgtgaccgcacgcaggtcgtcgttgcgccggtattcgccggggctgcggaagtcgtacacgtcgtagtcgccgttcgcgccgaagaagaacggcgatgtcgcgccggccgtgcagctcgccgcgtaatagcaaccgtacgcgaacgcgctgttgtcgtcgatcatcgtgcggctgcggccggcggcgatgtaggccttccagtcgtcgttgaactggtagtcgaagcgcacgttcaggttcagcgcgtcggtcgtcaccggcttcgcccacggctgcgtgccgagcgccttcgacgtcgtcttgaccgacggcacgacggtgccgccgagcagctggtagccgggggcggaacgctggatccactgctggaattcggcgttgagctgcaggctcgctcgcgggctgatgtcccagtcggcggcgatcgagccgaacgtgcgccgtccgttcgtgccgtcgatgtaggagtgcatgttctccttcgcggcattgatccggaagccgaactgattgtcggggccgaagcggcggccgagatcgacggccgccgacgtcgagccgcggctgtcgacgccacccgtcacgctcgcgacgttcgccgagcgcttggtcacgaagttgatcaccccgccgggcgcgacgacgccgctgtcgatgccggcaaggcccttcaggatctcgacgcgctccttgttctcgagcggcacgttctgttcgccggacaccgtcagcccgtcgatccggatcgcgctcgcgagatcgaccggaaagccgcggatcgcaaagccttcgaaataaccgaccggcgcatagtcgttgacgaccgacgcgtcgttgcgcacgacgtcgctcagccgcttcgcctgctggtcgtcgagctgcgcgcgcgtgacgacgctcaccgacgccggcgtgtcgcgcagcggcgcgtcgtcgagccccgcgacggatgccgtgcgtgcgcgcagcgcgttgccgcgctcgccgctcaccgtgatcgtcggcagcgtcgcgctgccgaccgccccggcgtccggcgccggcgtgtcgccctgcgccgcggcggcctgggccgcgaaaagcgtgatgccgacgccgacaccaagcccgaccttcgcgcgccgccgccgtgcgggcgacgctgttgttctattcaccgtcattgctctggatggaaaactcgccactcgaccctgtcgaaacccgttacgaagctgcgaagcgtgcccgcgaccggatctgcctccgccggacgcacgcgccggcacgacattcgtcagacgaaccgggcgaaccagacgatccggcacgcaagcgtgccgctcggtcgggaagacgcaggatgggacatcggattcaggtgacgcaccgggaaccgacgctgccgtcgaccggttcgtcggggcgtgtcgggcggccggctgcatcgcgcggtcttgtcatgcggggacgcttcgaacgccccggtacgggcgcgacggtctggcgcgcgccgttcgctggaacggcggcatgcccgtcgcgcacgacatcgcggcgcggcgcgcattttaccccgggcggggcgagctgccctggaatcgggcgaatcgggtgggtggggaaagcgggaatgggaaccgcgcgcttcgtgcggcacggcgacggtgccgatgtgcgcatgactgggcgtcgtgcgcggccacctcgatgaccggcaccgtcatgcgccggtcatgtggccggaaaccggagcgggaacgtttgcccgctcgcgattcggcggccggtcagaatccctgcatcgtcgcggtcgggtcgacgaccaggtgcacgacgccgtagatcaccgcgccgacgagcagcgcgagcacgatcgccacgaacggcaacaacgtgtagttgacgttcgcgagatcgctcgcgtgcgccttgctgttgcgtacgccgaagaaactccacaggaccagcttgatcatgccgagcagtttcatggttgtgctcctttcatcgaatcggttgacgctatcgtcgatccgaccggcatccgaaaaagaagcagttgcgcgcgcttttcgcgcagcaggccgtctgcggccgcatgtcgcagggtgcgtcagcggtcgagcacgagcggctccgacccttgcgcgggccgcgcgacgcacagcagcgcgcagccgggttcgaccggcgcatcgggcgcctgctcgtagtcgaccgcgccggacagcacgcgcgtcgcgcacgtgccgcacgacccggagcggcattcggacggcacggccacgcgctgcccttccgcgaattcgagcaacgtgccgtcggcgggcgtccacgcggcatcgcggccggtgcgccggaacaccaccggcacgcccgccgccggcgccccggtcgtgcgccgcgctgcgcgccacgctcgacggcccgaacgcctcgaagcggatgcgttcgtccggcacgttcagcgcgcgcagcccgtcgtacaggtcgcgcatgaacgccgacggcccgcacaggtagaagtcgtaatcgtcgaacgtcaggagccgcttcagttgcgcgaggtcgatgcggcctgcgtgcgccgccgccccgtcgtgaggatggctgtcgaaccagtggagcgacagccgtgcgtcggcggccgcgatgcgtgccagctccgccgcgaacggccggtcggccgcgtcgcgcgcgccatgcacgaacaccacgcggcgcgatggccgatcgtccgccagcgcgcggcgcagcatcgcggtcatcggcgtgatgccgatgccggccgacacgagcacggccgggcgcgggctcgcgagatcgaacgtgaagcgcccgcgcggcatctgcgcgtcgagcgccatgcccgcctgcgcgtgatcgtgcagccacgccgacacgcgcccttcgcgcttcacggtgatccggtaatgcgtgccgcccggcgcatcggagagcgtgtagctgcggatcgacggcgcgtcgcttcccggcagcgcgatgcgcagtgtcaggtgctgcccggcttcgtaggcgggcaatgcactgccgtccgccggttcgaaatggaacgagcgaatcgcgcgcgcttcgtcgacgatcttcgcgatgcgcagcggccgccatgcgggtgccgatgcgggtgccgatgccgatgtcgatgtcgatgtcgatgtcgatgtcgatgtcgatgtcgatagtgattctgatgcgggtgcggtgaccgacgcagttgaagtctgcaccaacccgcccgccgccatcgccgcgaactgcggcgcacgttcgaccgccgaccaccggaacggcagcaccgcgcgcatgcgccgcacttcccgcacatggaaccgcacgacccgctgcgcgccgtcgaacgatgcgacgagcggcccgtcccacacgatctcggcgcgcgcggccacatacagcaggtcgccgttgtcgaaatcgacgaacagcagccccgcacgcggatcgtgctgcaggttgccgagcgtgttgaagaagcggttgccgctgaaatccggcgtcgtcagcgtgtgcgcatcgtcgacgcgcacgaagcccggcatcccgccccgatgcgacacatccgcgccacgcgcagcgcccgcgtcggccgaggtgttcgcgctcgcgacgaacaacgtatcggcctgcgcaagcagcgctcgatcggcgtcgttcaacgcgtccgatacgtcgggcccggcggacgcgccggcttccctggcgacgaacgtcggcttgcgtccctggatgtacttcgcgcagttgccgaagctctgctcgaccgcgatcgtcagcgcatcgccgtcgaccgcgcgcacgacgccgttgacacgattgcgccgccgcgtatcgaattcgatcccgagcccgccgagcggcgcgcccggctgccacgcgccgtccagcggatcgcccggcaacgcgcgcgccgcgatgcgcagcgtacgcgggtccggcgacgtcacgaaccccggcgcgccggcgcgcagcgtcgcccacggctggccgttcgcatcgacgccgccaagcacgaaaaacggcagttgcgcgaaaaacgtccggtgctggtccggcatgaaacgccggatcccgcgccggccggccgaacccgcggccgccgtcacgcccgcgcgctgctgcacggcaagctctcccgcgtgaaacggcgcggtgtcgagttcccagcccggtacgacggtggtcggggtgttcatcgcgttctccgtgggcaggcgcggcgtcggtgggcgttacgcggcgagcaggccggcgcgcgtcgtcggcatcgcaacgaagcccggcagcgcctcgacgcgtgccagccacgcacgcacgttcggatacggttcgagcgacacgccgccttccggcgcgtgcgcgatgtacgagtaggcggcgacgtccgcaatcgtcggctgcgcaccggccgcaaacggcttgccggccagctcgcgatcgatcacgtcgagcactttcgcggccgtacgcttggccgcctcgtggtcgagcttcgcgccgaacacggtcacgagccgcgcggcagccggccccgctgcgatcggcccggccgcatacgagagccagcgctgcacgacggccgcgctggccgggtcgtcgggcagccagtgcgcgtcgccgtagcgcttcgcgaggtacacgaggatcgcgttcgaatcggcgatcaccgtgccgccgtcgtcgatcacgggcacctgcccgagcggattgagcgcgaggaacgccggttcgcgctgtgcgccggccgcgagatcgacgtcgacggtctccgaaggcaggccgagcagcgacaggaacaaccggacgcgatgcgcatgcccggagagcaggaacgagtagacgcgaatcggcgaagcaggcttgcggacggcagacatggaaaacactccggaatctcgcgccgccgggaatcggcgacgaacacctgcagcgtagcgctcgccgttcgtctccagaagatggataatcgcggaaacattatccgctcccataggacaatcgacgatggccgatctgcgcgacgtgaacctgaaccggctggcggtcttcgtcgcggtggtcgacgccgggtcgctgacggccgcggccgagcggctcggcctggcgaagacggtcgtcagcacgcacatgcagcgcctcgaatccgaggtcggcgcgaacctgctggtgcgcaccacgcggcggctgagcgtgaccgactcggggcgggcgttctacgacgcgtgccgcgacatcgtgcgcgccgccgaaagcgcgctcgacgcggtgtcgtccgacgcggggccgctgcgcggcacgctgcgcgtgagcgtgccgatcgactacggcgcgctggtcgtcgcgcctgccgtcgtcgcgttgcgcgaccggcatccgggcctcgacgtcgaactcgtcgcgaacgaccgcgtcgtcgatctcgtcgcggacaacctcgacgtcgcgatccgcatcggccgcctcgccgattcgaactatcgcgcggtgcagctcggcacctacgagaaatggctggtcgcgagccccgcgttcgtcgcgcgccacgggcggccgcaggataccgatgcgctcgccgcgctgccgttcgtgatgctgtcgacgctgccgcgcccgcatacgctcgaactcgaagacgcgaacggcggcaccgcttcggtgcgctgtgtcgcgcacgtcgtgtcgaacaccgccaccgcgtgccgcgcgatcgtgctcgcgggcggcggcttcgggctgctgacggacttttcgaccgccgacgacctcacggccggccggctcgtgcggctgctgcccgcgtggcgctcggcgccggccgggatccatgcggtgtatccgtcgacgcggctgccttcgccgaaggtgcgggcgtttattgatgcgatgaagcagaggatcgacgacacgcggccggcacgcaagacgaaacgcgaacgctagcgcacgccgaattccgttgcggctgcgcgccgcgccgttgccggcccgcgcattccattcctccgatgtatcgcgacatcctcgcgaccacgcatcgccatgcaaggcgctcatgcgcggcatgaaaactaatcgattgttggcgccccggatcgacgccgacaatccgctgcatgcccctcgtttgcggtacgggccactcctcccaatcggcacgtcacgatccatgaaccatccagtcccctctcctgcatcgccgaggcccgcacggccgcgccggcaccgttccttgcccgtccccgcacctgcggcgaagcactcgtcgacctgctcgaacgttatggcgtcgaatgcgtgttcggcattcccggcgtgcataccgtcgagctgtatcgcgggctcgcagagtcgtcgatccgccatgtgacgccgcgccacgaacaggggccggcttcatggccgacggctacgcgcgcgtcacgggccggccgggcgtctgcttcatcatcaccgggccgggcatgaccaatatcgcgaccgcgatggcacaggcctacgcggattcgatcccgatgctggtgatctcgagcgtcaacgcacggcgcgagctcggcagcggcgacggccgcctgcacgagctgccgtcgcagcgtgaagtcttcgcgggactcaccgcgttctcgcacacgctgctcgacgcggccgacctgccgcaggtgctcgcgcgcgcgttcgcggtcttcgaaagcgcacggccgcggcccgtgcacatcgagattccgctcgacgtgatcgtgatgccggcgcccgcgctgcccgccgcgccacccgcgctgcccgcccgccccgcaccggacgccggcgcgctcgcggcggccgcggacctgctcgcccacgcgcgccggccgctgatcctggcaggcggcggcgccgtgcatgcggcggccgaattgcgcgagctcgccgaacgcctgcacgcgccggtcgcgctgacgatcaacgcgaagggtctgctgccggccggccatccgttgctgatcggctccacgcaatcgctgcccgccacccgcgcgacgatccgcgacgccgacgtggtgctcgccgtcggcaccgagctcggcgaaacggattacgacgtcacgttcgacggcggcttcgcgatcgatggccggctgattcgcatcgacatcgacgcgcagcgctgcgcaatgcccgcgcggagatcgccatcgccggcgattcgcggctggcgctcggcgcgctgtcgacccgcctgcacgaaaaaccgacgacgcccccgaagccggctggggcgcgccgcgcgtggccgccgtgcgcgccgcgatcgcgtcgggccacgacggcccggcccgcgcgcaggcgcggctgatcgacacgatcgtcgcggcgctgcctggcgtaatcgtcgccggcgattcgacgagccccgtgtacgtcggtaatttcacccacgacgcgcacgcaccgcgcagctggttcaactcgtctaccggctacggcacgctcggctacgggctgcccgccgcgatcggcgcgaaactcgccgcgcccgcacgcccggtcgtctgcctgatcggcgacggcggcctgcagttcacgttgccggagctcgcgagcgcggtcgaggcccgcgtgccggtgatcgtgatcgtctggaacaaccgcggctacggcgagatccgcaaatacatggtcgcgcgcgacatcacgccgatcggcgtcgatccgtacacgcccgatttcctggcgctcgcgcgcggcttcggctgcgcggcgcacgcggccgcgacgcccgacgcactggctgccacgttgcgcgacgccgtcgcgcgcgcgatcccgaccgtgatcgagatcgacgaagcgacatggttcgagcaggtgcagcgatgagtcaggccccgattttcactttgatccgccgctgcgtaccgggcttttcatcgccggcgcgtggggtccggcgccgacggcgccacgttgccgatcgtcgatccgtcgactgaagcggtcctcgcgcatgtggctgccggcggcagcgcggacgtcgagcgcgccgtccaggccgcggcccgcgcgtttcccggctggaaacgcacgacgggtgccgcgcgcgcggccctgctccgcgcgatcgcgcgcggcgtcgacacgcaccgcacacggctcgcgacgctgcagtcgttcaataacggcaagccgttcgccgaagcggagatcgacgtcgccgacgtgatcgccacgttcgactactacgccagcctcgcggaacgcatcgacaccgacggcgaaaccgaggtcgcgctgcccggcgacgaccaccgcgcatggatccggcgcgaaccggccggcgtcgccgcgctgatcgtgccgtggaatttcccgatggtgacgaccgcgtggaagctcgcgccggcgctcgcggccggctgtaccgtcgtgctgaagccgtccgagatcacgccgctgccggaactcgaactcgtcgcgatcgccgccgcagcgggcctgccgccaggcgtgctgaacgtcgtgacgggcaccggccccgacgtcggtgcccggctgtgcgcgcatccgctcgtcgcgaaggtgtcgtttaccggcagcacggcggtcggcgcgcaggtcatgaaaacggccgcggacacgatcaagggcgtcggcctcgaactcggcggcaagtcgtcgatcgtcgtgttcgacgacgccgatcccgaccacgcggtcgagctgatcgcgggcggcggcctgttcaacgcggggcagatgtgttcggcgacctcgcgcgtgctcgtcgccgcgccgctcgccgacgacctgatcgcacgcctcgcgcggcggatcgacgcgaccgtcgtcggcccgccgttcgcgcccggcgtgcagatgggcccgctgacgaaccgcgcgcaatacgaacgcgtgaagcgccacatcgcgcaaggccgcgccgacggcgcgcggctcgtgacgggcggcgacgtgcccgccggccccggttacttcatccggcccgcgctgttcgccgacgtgccggccgacagcccgctatggcgcgacgaaatcttcgggccggtgctgtgcgtccgcacgttcgataccgagtacgacgcgatcgcggccgccaacgataccgaatacgggctcgtcgcgaccgtcgtcacgcgcgacgcggcacgcggcaagcgggtcgccgacgcgctcgaagcaggcgtcgtgtggatcaacacgccgcaactgatctatccgcaaacctcatggggcggctacaagcgcagcagcgtcggacgcgagctcggcccgttcgggctggccgcattccaggagatcaagcaggtcatgatgccggcccgctgaggccgtccgggccatgcgtttatctcatgccgcgcatgcggatatttcgtttgttgcggaaatttgacgtccctacagtgcatccacaccccgcgccgccattcggcgaccggcatcgaaccacccggcatcgttcatcaggagacggccatgcaacacttcaaggcgggcagaaggcaggtgatcaaaaccctcggcacggcactcgccgcatccgcccttccgatgccgttcatcagtactgcgaaggcacagacgagcagcttcgcgggcaagacgctgcgcatcctcacgtggtctgacgataccggtgcggccgcgctgcgcaacatcgcggaaacgttcagcaagcagaccggcgcacgcgtgatcgccgaccgcgcggacggcacgtcgggcatggtcgcgaaggtcaaggccgccggcgagcggccgacctacgacgtgatcacgctggccggcgtcggtgcggccggcctcgccgatgcgggcctgctcgcgaagccggacctgaaccggctgccgaacctgaaggacgtcgcgccgcagtaccgcacgggcgcaaacgggttcggtgtcggctacctgctgtggtcggacgggctgatctacaacacgtcgaccgtcaagaccgcaccggcgagctacgaagcgctgtgggatccgaaatatgcggggcgcctgtttcttccgccgccggagtgggccgaggcggtcgatctcgcgatcgtcgccgcgaagctggccggcggttcgcagcagaacatcgagccgggcttccgcaagctcgcggcgctcaaggatcgtgtgatgacgctcggcgaaaacccgaaccaggtcgccgacctgttccgcaccggctcgctcgacatcggcggcatctattcgcccgcgttcttcccggaccagatccgcaagcccgactacaagatgggcgtgacgtacgggatgaaggaaggcttcgcgacgcaactgatgttcacggtgattccgaaagcgcacccgggcgacctcgacctgatccatgcgttcatcaaccacacgctcgacgcgggcgtgcagggccggatggcggcggacgtgctgaacgggccggtgaattcgaaggccgtgatcccggcggaaagccgcgcattcgtgccgtcgccgcagcagatcgcggagaaggccatcctccacgacgacaaggcgctcgccgccgttcagccggcgtggatcaagcgctataccagcctcttcgcggcctgacgacatggcctcgctgccttcctcccgtcacgcggaacccagcgccgccggcccggccggcggcgcttcggccgccgctgccgcgcggcccggcgtgccgccgtggctgctgcttgcgccgatcctcgcattcctcgcggtgctcgcggcggcgacgctcaccgtgctgcggatgagcgtcggtacgccgggcgacgaatggcgcacgttcacgctgcagaactacgccgatctcgccgacccgtacttcatgcactcgctgtggctcacgctgcgcctcgcgttccagagcatggtatgcgcggtgctgctcgcgatcccggtcgcgctggcgatggcgcgcgccgaatcgcggctcgcgcggcgactcatgcttgccggcgtgctgctgccgctgctcgtcaacctgctgctgcagggttacggctggctcgtgatgctcggcccggcgggcctgctcaaccgctcgctgctggcggccggcgtcatcgaacggccactgcagctgctgtaccgcgaacacggcgtgctgctcgggctgatccagactgcattcccgctcgccgtgctgccgctgtcgagcgcgctgcgtgccgtgtcccgcgcgtacgacgaagccgccgcgacgctcggcgcgacgcgctggcagacgctgcggcacgtgacgctgccgctcgcgatgccggggctcgtatcgggcgcgctgctcgtgttcgcctacaacgcgagtgcgttcgcggtgccgctgctgctcggcggccggcgcgtaccgatgctcgcggtgctcgtgcatgaccaggtcgcgccgctgctgaactggccggccgcgtcggcctcgggtgtcgtgctgatgggcgcgacgctcgtcgtgatggcggtttcccagcgcctcgtgcgcgccctgcaacgtgacgaggtgaaccgatgaatgcccttctgccgcgagcaccgctgcccggccgtctgagccgcgcgaccggcaccctcgcgacgctcgtgctgtgcctcgccgcactgccgatcgtgacgatgatcacgatgtcgttcggctcgtcgggcacgctcgaattcccgccgcgcgatttcagcctgcactggtaccgcgccgcctggcagaccttcgtgaccgccgatgccggcagtgcgcaatcgatgggtgccgcgctgacgacgagcctcgtcgtcgcgatcgcgacgatgctggtcgcgactgcggtttcggtacccgccgcctacgcgctgtcgcgttatcgcttccgcggcaagacgttcgtcgagcagctcgtcgcgctgccgatcgtctatccgctcgtcatgctcggcctcgcgctgctgctcgtgttcaacgcactgccggtcgaactcgggctcgtgcggctcgtcgtcgcgcacgtgatcctgacgctgccgtttaccgtgaagaactgcgcggcatcggtcgcgtcgatcggcccggaattcgaggaagccgcgtgcctgatgggcgcgagcccgcgccgcgcgttcgtcgatgtcgtcctgccgctgatgcggccgggcgtcctcgccggcatgctgttcgcgttcatcgtgtcgttcaacgagttcacggtgacgttcttcctgtacagcgtcgacacgatgacgctgccggtctggctctacagccgcaccgtgtcgtcgctcgacccgaccgtgttctgtttcgcggcgttcaccgtcgcgatcgatttcgcgctgatctggatgctcgaaaaactcgtcggcgacaagggcgttgcgctctgatacgcgcacgactccgccctcgcccatccaaggactccccatgacccagctcacccttcagagcgtgacgaagcgcttccagcacgcgtatgccgtggatcacgtcgacctgtccgtgccggacggcaagctcgtctgctttctcggcccgtcgggctgcggcaagaccacgctgatgcggatcatcgccggcctcgagacgccgacgtcgggcacgatcacgttcgccggccgcgacctcacgcacgtgccggccaaccggcgcgacttcggcatggtgttccagtcgctcgcgctgttcccgcacatgacggtcgcgcagaacatcgcgtatccgctgcggctgcgcaagacggccaggacggctcaaacgcagcgtgtcgcggagctgctggaactcatccagcttccgcacctggccaaccgcctcgtcacgcaactgtcgggcgggcagcgccagcgcgtcgcgatcgcacgcgcgatcgcttcgtctccgcgcctgctgctgctcgacgagccgctgtcggcgctcgacgcgaagctgcgcgaggcgatgcaggtcgagatccggctgctccagcaacggctcggcatcacgacgatcatggtcacgcacgaccagcgcgaagcgatgacgatggccgacgagatcgtcgtaatggagaaaggccgcatccagcaggtcggccggccgctcgacatctatcgcgatccggtcaacgaattcgtcgcggatttcatcggcctcggcaacatcctgccggtcgcgtgcgacggcgacgacgcgatcgtgctgccgggcggacaacggctcgcgatccggcgcgcgcccgacgcgccgcgcgcggacgacgccgtgcgcctgctgattcgccccgaggacgtgtgcgtgcgcgcagcctcggtctcgccgtccgcgccgaacacgctcgccggcacggtcacgttcgtgcgcgacgtcggcgcgtcgatcgaggcgacgatcgattgccgcggcttcacgctgacggcagcgacgacgccgcgcgaaacgcccgacctgcacgtcggcatgccggtcgccgccgagctacccgcgcatgcatgcaagctgatcgccgcacgcggcgcctgatttccggttctttccccagcgcagcaacaaggactccatcatgaacgcatcgacccaagcccaccgtctcgtgcgacgcctgctcgcccgcaccgccctcgtctgcacctgcgcggcgggtctcgccgccatcgcgccgctcgcacatgccgacgcactcgacacgatcgcgaaatccggcgtcgtgcgcatcggcgtgttcgaggactacccgccgttcggctcgatcggccccgacatgaagccgcaaggttacgacatcgacatggcgacgctgatcggcaaggcgctcaacgcgaaggtcgagctcgtgcaggtcaccggcgacaaccgaatggcgtatctcgccgaccgcaagaccgacatgctgctgtcggtcggccagacgccggagcgcgcgaaggtgatcgatttctcgaacgcgtatgcgccgtactatctcgcggtattcggcccgaaatcgctcgccgtgaaaggcaccgccgatctcgccggcaagtcggtcgcggtcgcgcgcggcacgctcgaggacctgagcgtgagcaaggtcgcgccgccgaacgcgacgatcaagcgcttcgacgatccaaacggcgcgatcgcggcgttcctgtcggggcaggcgcaactgctcgtgatcggcaacgacgtcggcgcgacgatcatcgcgcgccatccgtcggtcgatccggagcagaagttctcgctgttcagctcgcccgatcacgtcggcctgaacaagaacgagccgcgcttgatgcagaaggtcaatgacgcgatcgccggcgcgaagaaaagcggcacgctgaacaccctgtcgcagaagtggctgcacgcggcactgccggccgacctgtgacgcgcgtcgcgcccgccccgcattcacgacggaaggtatcgttatgacctacgtgttcgacttcagcgatttcggcctctacgccggcatgctcgcgcgcgggatcggcgtgacgctcggcctcaccgcggcctccaccgcgctcggcggcctgatcggcaccgccggcgcgtgggccgcgctcgccggcccgcgctgggcacgcacgctggtcgcggcctatgtcgagctgatccgcaatacgccgttcctggtccagctgttcttcatcttcttcgggctgcccgggatcggcgtgcacatcgacgaagcgcaggcggccgtgctggcgatgacggtcaacctgggcgcgtatgcggtcgagatcctgcgggccggcatcgaatcggttccgcacgggcaaacgcaggccgcacgtgcgctcgggctgcacggccggcaggtgttcggtcaggtcgtgctgccgcaggcgctcgcgaacgtgtaccccgcgctgctcgggcaggtgctgatcgtgatgctcggttctgccgtcgtgtcgcagatctcggtgcccgacctgacctatgcggcgaacttcatccagtcgcgcaatttccgtgcgttcgagatctacatcgtcgtgactgcgatctacctactgctgtcgatcgcgctgcgcatgctgctcaatcgcgtcggccgccgtctgttcgcgggccgcgcgccgcacggtgcgggcaacgcaccgcgccgctcgtgcgttgcccgctttacgtggcgcgcgcgctccctgaaaccggcctcccgacggagcgtgcccgatgatcgaattcaccttccaggatattgcgtggaacctgctgctggccgcgcgctggaccatgctgctgtcgctgatcacgttcgtcggcggcagcgtcgccgggtttgcgctgctcgcgatgcgcatctcgccgatgccggcgctgcgccgcttcgtgagcctgtacgtcgagctgtttcagggcacgccgttgctgatgcagctgttcctcggtttcttcgggctgccgctgatcggcatcgacgtgacgccgtggaccgccgcatcggtcgtattgacgttgaacgcgagcgcatacctggccgacatctggcgcggctgcgtcgacgccgtgccgcgcggccagtggagtgcggcggccagcctcggcatgacgtggacgcaacaactccgttacgcggtgtggccgcaggcatggaaaatcgcgctgccgccgaccgtcggctttctcgtgcaggcggtgaagagcacggcgctgacgtcgatcatcgggctgaccgaactcacgaagaccggcaacatcatcaccaatgcggtgttcaagccgtttccgatctacgcgatggtcgcgctgctctacttcgcgatgtgcttcccgttgacgtggtacgcccgcgtgctcgaacgccgctaccgcgtcgcgaaggcacgctgaaccggcgccgcgcgcgcctcattacgatgcaggtatccccatgatttccatcagcaacgtttcgaagtggtacggcccgtttcaggtcctcaccgactgcacgaccgaggtcaggaaaggcgaagtggtcgtcgtgtgcggcccgtcgggctcgggcaagtcgacgctgatcaagaccgtcaacggcctcgagccgttccagcagggcgagatcctcgtgaacggccagtcggtcggcgacaagaagacgaacctgtcgaagctgcgctcgaaggtcgggatggtgttccagcatttcgagctgttcccgcacctgtcgatcaccgagaacctgacgctcgcgcagatcaaggtgctcggccgcggcaaggacgaggcgaacgagaagggtctgaagctgctcgaccgcgtcggcctgaaggcgcacgcgcacaagttcccgggccagttgtcgggcggccagcagcagcgtgtcgcgatcgcgcgcgcgctgtcgatggacccgatcgcgatgctgttcgacgagccgacgtccgcgctcgaccccgagatgatcaacgaagtgctcgacgtgatggtcgaactcgcgcaggaagggatgacgatgatggtcgtcacgcacgagatgggcttcgcgaagaaggtcgcgcatcgcgtgatcttcatggacaagggcgcgatcgtcgaggacgaccgcaaggacgatttcttctcgcatccgagatcggaacgcgcgaaggacttcctcgcgaagatcctgcactgaacgctgccgcgacgcgccgcacccgccccttccgatcgtccgttccatgccggcctttccgatgaaacgactaccttccctcaacgcgctgcagatcttcgacatcgtcgcccgccacggcagcttcacgcgcgccgccgagcagctgtgcctgacgcagggtgcggtgagccggcaggtcctcgcgctggaggcgttctaccagttcccgctattcaagcgcacgccaaagggactgacgctgacggcggaaggcgagctgctgttaccgacggtgcgcgagagctttgcgcgcatcgaagaggtatcgatgcgcctgtcgcgccggcgcaccgagctcgcgctgaaggtgccgacctgcatgatgcagtggatgttgccgcggatcatgcggtttcagtccgagcacccggaactccaggtgcagatcacgacgacctggggccatcacgtcgatttccgcatggagccgttcgacgccgcggtgatctacgccccggcgccggccccgacatgcatgcgatcccgctgttcgaagagcggctcacgccggtatgctcgccggacctgctgaaccggcatccgctctcaagcgtcgacgacctggccgaccatacgctgctgcatccgacccgcgatcaccgcgactggaaacggtggctcgaccatgcgggcgcaccgcacgtcgactcgacgcgcggattgagcttcgagacgctcgacctcgccacccacgcggcgatcgacggctacggcatcgcgatcggcgaccggacgctcgtcgacgaaagcgtggcggcgcaccggctcgtgacgccgttcgacgtgtcgatgccgaccgggatgggctattacttcgtgtatccgggcggcgccgagcagcagcagaagatccagctgttcggcgactggatcacgggcgaacgcgagcgccagacctccgttttcaatcggcgcgcgtgagccggctcatcggcacggcacgcaagcgcttgcgtgccgcatacggccgcccggcgcgcccgaccggatccggcccgcgcaataccggcaggcggcgatttccctcgcttccagttcgctttcgaaccgctccgcaaccgtgaatagacgagattattgaatccaaaaattcgatattttattttcggcttatccactaaactttttcatggcaattcgctgacctgcgtttgccgaagcacttcaattctccgacccattaaatcaatcaaggagtttgaaatgtaagctgccgcaatttcatcgggaaccacaccgtcgattcgtgtcgacgcggccaacggcaaccggatcaccgggcactgctgctacggccagggccggcacacgggcgcgttcagccaggcaggcgacaacgtgtcggcgacgtgccggcgggtcggcagcgccggcacgacgaccgagtatcgccgggacggcgaaggccgaaccggggcggatacacgggttcctgatcgaggtgcctgggcgctgagggtttcgcgccatgaacggcgcaatgcgaactgccttttgcattgcgccgccttttaatttgatccggattgttttaacccgctcatcgtcacacgcaaaccgaatcaaatcaaaaagagacaacccgacgtgccgtgcgccgtgtattggcttctttattttgactttgaacctgcaatttgccggcggacatgcggggaacaacgcgacaccatccggtcagcttatctcccgcaacgtccccaacagcaccttcctgcaactcgcgaccatctgcgcttccggatcgcgatattccgtgagcagccatgccgcgccgacgttcgtcatcgcgccgacgagcgcgagcccgatcagccgctgctcggtgcgctccgcgggcgtcgccgcttcgcgcggcgcgccgatcgccatgatcagcttgccgaagtcgatcagcatgcgctggtaggtcatgtcggtgtccgcgctcacgcccatcacctcgagcagcagcacgcgcgccgcgcacgggtcgcgcaggaacgcgaagaacgcggcgagcccggcatcgatgctctcgcgcagatcgccgccgcgctcggccactgcccgctcgactgcctcgtgcaactgctgcgcgtgatgcaggtaggtgcagcgcagcaaatcctcggtgctgtcgaacgccgcataaaaatagcgatcgttcagcttcgcttcctggcagatcgaccgtaccgtcgccttgcggaacccgaccgtgccgaacacacgcgtcgccgcgcggatcagcgcgtcgcgccgctcggcggcccgcacctcgggcgccacgccgccatacgagcggccccgtttttccgtttcgagtgctttctccattccgctatttgacatcaggacacccgaaaactaaagtggtgacgaccaacaccacattagacgcgccgccggcacggggcaagcggaacgggaggagcaacggatgaacgggttttccggcaaggtcgccgcgatcacgggcgccggttcgggcatgggccgcagcctcgcggtcgagcttgcgcggcgtggctgcgaggtcgcgctcgccgacgtcaacgaaaccgggctcgccggcactgcggccgcctgcgctcagcatggcgtgcgcgtgagcacgcggcggctcgacgtcgccgaccgcgatgcggtgttcgcgtgggccgatttcgtgcgcgccgggcatggcaaggtcaacctgatcttcaacaacgcgggcgtgtcgctggccgccagcgccgagaccgcgggcatcgccgatctcgaatggatcgtcggcatcaacttctggggcgtcgtgcacggcacgcaggcattcctgccgcacctgcgcgcgtcgggcgacggtcacgtcgtcaatacgtcgagcctgttcgggctcgtcgcgatgcccacacaaagcgcttacaacgcgaccaagttcgcggtgcgcggctttaccgaggcactgcggatggagctcgaactcgacggcgcgccggtgagcgcgacctgcgtgcatccgggcggcgtcgcgacgaacatcgtcgacgcgggccgcgtcgataccagcatccacgcactcacgggtcaggacgaagcgacccatcgccgccaggcgaaccggctgatcaacgcgacgacggccgacgaggccgcgcggcagatcctcgcgggtgtcgagcgcaatgcgcgccgcgtgctcgtcggcgccgacgcacgccggctcgacaggatcgcgcgcctgctcggcgcgggttaccagtggctgatgctgcgccacgtgcgtcgcgcccgggcccgcaacctccgcccgaaggaagccccggccgcgctcgcgaccacgcccaccaaggaccccgcatgacctcgacgacaaccgaccggcgcgacgcgccgcccgcccccggcgacagccgcgacctcgacgtgctgatcgtcggtgccggcctgtccggcatcggcgcggcgtatcacctgaagcagcgctgcccgtatgcaagcgtggccatcgtcgaggcgcgcgacgcgatcggcggcacctgggacctgttccgctatccgggcgtccgttcggattccgacatgttcacgctcggctacagcttccgcccgtggcacagcgacaaggcaatctccgacggccagacgatcctcgactacatccgcgacaccgcgcgcacctacggtatcgacaagacgatccgttacggccagaaagtcgtcgcggccgactgggattcgaaccgcgcgcgctggacggtgcgcatcgagcgcacgcagggcggcacgaccgacacgctcgtctacacctgccgcttcctgttcatgtgcagcggctactacgactacgacgccggctacctgcccgactgggccgggatggacacgttcgaaggcaagctcgtgcatccgcagcactggccgaaggacctgtcgtacgcgaaccggcgcgtcgtcgtgatcggcagcggcgcgacggccgtcacgctcgtgccgtcgatggcggccgacgcgcagcacgtgacgatgctgcagcgctcgccgacctacatcgtgtcgctgcccgcgcgcgacaagatcgcgaatgcgttgcgccgcgtgctgccgtcccggctcgcgcaccggctcgtgcgcgtgaagaacgtgctgctgacgatttacctgtacaacgtgtcgcgccgcaagcccgaccagacgaagaagttcatcatccgcgcggccagcaagcagctcggccccgacttcgacgtcgcgaagcacctgacgccgcgctacatgccgtgggaccagcgcgtgtgcctcgtgccgaacggcgacctgttcaagtcgatccgcgcgggccgcgcgtcgatcgtcaccgacgagatcgagcgcttcacgccgaccggcctcaagctgaagagcggccagcagctcgacgcggacgtgatcgtcaccgcgaccgggctgaaggtgaagatgctcggcggcgcgcgcgtcacggtcgacggccgcgcggtcgacctgccggagaccgtgtcgtacaagggaatgatgtacagcgacgtgccgaacctcgcgtcgtcgttcggctacacgaacgcgtcgtggacgctgaaggccgagctgatcgcgcgctacgtgtgccggctgctcaaccacatgcgcgcgaacgactacgacacgtgcgtgccgcggctcggcgccggcgagctcggcgacgtgccggccgtcaacctgagctcgggctacatccagcgcgcggccggcatcctgccgaagcagggccatcgcaagccgtggaaattccaccagaactacgtgcgcgatctcgcgtcgctgaagttcagcgcgctcgccgattcggcgatgcatttcgaacgccgcgcgaaagccggcgcggccgccgcggcgccggttgccgaacccgcactcgaaccccgttgaggccgacatgacccctacgctccatctgattcagaacgtattgttcggcgtcgtcgcggcgctcgccgcgctcgcgctgtttaccggttatgtggcccgtcgcgtgacgcgtgcgtttccgcccgaaggccgcttcgtcgacgtcggcggcgaccgcatccactacgtcgaatacggtaacggcccgccgatcgtgttcgtccacgggctcgccgggcaactgcgcaatttcgcgtacctgccgctcgcacggctcgcgcagcggcatcgcgtgatcctcatcgaccgcccgggcgccggccgctcgctgcgcggcgcggcttcgcaggcgaacgtgttcgcgcaggcccgcacggtcgccgcgttcatcgacgcgctgcggctcgacaagcccgtgctggtcggccactcgctcggcggcgcgatcgcgcttgccgtcggcctcaaccatgcggaccgcgtgagccggctcgccctgatcgcgccgctgtcgcaccagcagaccgagccgccggcgccgttcaagccgctgatgctgccctcgccgctcgtgcgccgcttcgtgtcgtggaccttcgcgatcccgctgacgatcctgaccggccgcaaggccgtgcgccaggtgttcgcgccggaagacgtgccgcgcgacttcccggtcaagggcggcggcctgctcgggatgcgcccgcacgtgttctacgcgacggcgaccgacctgctgtcggcacccgtcgacctgcccgcgatggaacgccgctatgcggacctcgcgctgccggtcgacgtgctgtacggccgcgccgatccgatcctgaactggcgcgagcacggcgacgcgctcgcgaagaaatcggcgcgcgtgcggctgaaggtcgtcgagggcgggcacatgctgccggtcacgattccggaagccaccgccgactggctgctcgaagtcgccgccgccccggccgaggcggcaccgcaggcagcgcgcgtcgcgcactgagccggaaagcggcgaaaccagcgaaaccgggcctgattccgcgcccgccgtacagccgaagcggcggcggaatcaggcttcgtcgtcgggcaccgacagcccgagatccgagatcacctcccgcgcgctgcggaatgcctcgaccgcggccggcgcgcccgcgtacagcgcgctgtgcagcaacacctcgcggatctcgacgaggctcgcgccgttgttgagcgcgccgcgaatgtgccccttcagttccgtgccgcggccgagcgccgccagcatcgcgcacgtgcacaggctgcgcgtcttcaggtcgatcccgtcccgctgccacgtgctgccccacgcgtgctcgttcagccagttctgcagcgggcgcgaaaaaccgtcgagatcgcgcatcgcgcgctcgacgaacgcctcgcccatcacgtcgattcgtcgcgccttgccgttttccctgtcctgttcgctcatgtccggttcctgtatggagtcgtggccgcttcggcatcgtcggcagccggggatttcgcgccatgttcatcgggccggcacgtttcgtcaaagatgcggccctcggttcgaggccatccgcgcaacgcgatatcgaacgctacgtaacatcgcgccgcgcgttacggcggcttacgggaacatcgcaaccgccgcgcccgcgcaccgagcatgcccgtcgcgcgaaagcgccgttactccgtttaaatcgcgccgatcttcccgattcctgcaataaagcgcgacaccgtttcgcgaatgctgtcgtggcgcggaatttgcagaggaggcttggacacacttccaatgtcgaggccaacatgcacacactcttcaagaagacgacggtaacgatggccgtctcgtcgctgctcgcactatatggttgcggctcggtcgatggaccgacgaccccgccgacgatcaagccgagcacgtcagggacgggcggcagctcggggacttcgggtacgtcgggcggtgggacgtcggggacttcggggcgggacttcgggtagttcggggacttcgggtacgtcgggtacttccggcacctcgggtacctccggtacgtcgggcacttccggcacctcgggcacttccggtacgtcgggtacttccggcacctcgggtacttccggtacgtcgggcacttccggtacgtcgggcacttccggtacgtcgggtacttccggcacctcgggcacctccggtacgtcgggtacctccggcacgtcgggcacttccggtacgtcgggtacttccggtacgtcgggtacttccggtacgtcgggtacttccggcacctcgggcacttccggtacctcgggcacctccggtacgtcgggcacttccggtacgtcgggtacttccggcacctcgggtacctccggcacctcgggcacttccggcacctcgggcacttccggcacctcgggcacctccggtacgtcgggcacttccggtacgtcgggcacttccggtacgtcgggtacttccggtacgtcgggtacttccggtacctcgggtacttccggtacgtcgggtacctccggtacgtcgggcacttccggcacctcgggtacttccggcacctcgggtacctccggcacgtcgggcacttccggcacctcgggcacctccggtacgtcgggcacttccggtacgtcgggtacctccggcacctcgggcacctccggtacgtcgggtacgtcgggtacgtcgggtacgtcgggcacctccggtacgtcgggtacgtcgggtacgtccggtacctcgggtacgtcgggcacctcgggcacttccggcaccggcgtcaccccgctcggcaatgtcctccagaaatccggcaacctcgtgacggcagtcggtacgacggtcgcgaacggcggcggcgtgatcggcggcgtgcagatccccggcacgaacccgacgacggccaacagcgtcggcaacgcggtcacgagcctcggcaacggcgtgcaggcgctcggcaacggcgtcgcggccggcctcggctcgatcggcgtgtcggcgaacccgctcgggccgacgctgacgtcgaccaccggcctgctgaccggcgccggcggcgcggtcaacaacctcggcaacgcggtgaagagcctcggctccggcccgctgtcgccgctgtcgccggtcacgacgctcgtcggcgatctcgtcaacaccgtgggcggcgccgtcaactcgaccgcgtcgggcctcaacacggcgctgaacagctcgccggtccagcagctcgagacgcaggtcggcaaggtgatcaacccgatcacgaacacgctgaccggcggtgtcacgacgccgggcgccacgcagacgctcggcggcgtcacgctgctcggcacgccgctcaacggcctgctgagcgcgctcggcaacggcctcgccctcgccggcacgaaggtcggcggcgcaaccggcaacccggtcggcaccggcctcggcggcgtcgtggcacagctcggcaacacggtgacgtccaccggcggcctcgtccacgacaacaacgcgggcagctccagcagcggcacgggcggcagcaacccgctcgccccgatcacgggcctgctcggcacgctgacgggcggcctgggcggcggcagctcgagcggttcgggcggcacgagcggcacgagcagcggcggcccgctcggaccggtcacgggcctgctcggctcgctgacgggtgcgctcggcggcctcggttcgagcggcacgagcggcaccggcggaacgagtggcaccagcggcaccggtggcgcaggtgtcggcggcctgctggcgccggtcaccaacctcgtcaattcgctgacgccgctcggcgccagcctcacaggcacggtcacgacgccgggcggcaacgtgacgggcacgctcggcggcctgctgtcgagcggcccggtcggcacggtgacgggtgcgctgacgacgccggcaggcgccgcgggcgccatcggcaccgcgagcccgggcggcgcggccggcacggccacgacgcctgccggcggcggctccgtggcggccggcctgaccggcagctcgaacggcggtgccgcgggcggcgccggcaacctgctgtcgccggtgacgaacctcctcggcggtctgctgggcggcggcaccaagaagtaacgctttacctatcagaaccacaggccaatggccgggcgcgcatccatacaaagcccggccgacggccggcgtcacccgccaagcgggggcgccggccttcacccgtacgaggatccgatcatgaactccacgcttgacggcatcgccgcggtccaggaccgcccgccccgttccgccacgcccctgcgcgccggcctgctcggcatcgccgccggactgttcgcgctgtggatcacgcgcggccagccgactttcgatgcggccacgcgcgcggtcatcgccagcctcgcgatcatcggcacgatcgcgctgcacgaaatcttcatctcgcgcgtctacctgcgcccgagcgcgggcctgtcgcggcaggccgtccgcccgctcggcatcgcgcgcgtcgcgacgcggctcggcgcattggcgtcgatctatgcgggcatcggcgcgatctactggctgctgcccgaataccacggcgcgttctaccggccgttctggtcgctgctgcgctcgctcgcgccgtacgtgatcgtcgccgcgccgttctacttcgcgtggatggatcgccaccagcgcgagaccgacgatgcctacctgctgtggggccgcttcctgttccgccgcgagcagcccgcgagctggaagccggtgcgcgagatgctggccggctggggcgtgaaggcgttcttcctgccgctgatgaccgtctacctgtcgaaggacgccgatcatctgaccgcgtcgctcgcgaacgcgatgcacgcgccggcgacgatcgcgaccttcatgttcatgtacgacctgtcgttcacgatggacctgatgttcggcaccgtcggctacctgtgcacgttccgcatcctcgacagccacgtgcgcaccgtcgagccgactacgctcggctgggtagccgcgctgatgtgctaccagccgttctggtcgctgttctcgaacaactacatccgctacgaaggcacgttgttctgggacaactggctgctgtcggccccgacgctgcgcgtgatctggggcacggtgatcatcctgctgctgctgacctacgcgctgtgcacgatctcgttcgggctgcgtttctcgaacctcaccaaccgcgggatcatcacgtcgggcccgtaccgcttcacgaagcatccggcgtacatcacgaagaacctgtcgtactggatggtgtcggtaccgttcgtcgagccgctcggctggcaggtcgggctcatgcactgcgcggggctcgtcgcggtcaacctgatctactacacgcgggcgaagaccgaggaacggcacctgatgcgcgaccccgactatcgcgcgtatgccgaatggatcgcgcagcacgggttgttcgcgcggatgaggcaggcgttcgggcagcgcgcgccggcctgacgcggcggcgcaaggcggggcctgctggcccgcccacggttgacggcaccggccgcgcgcccgcgactccgccggagcgccgcgccgccggaaatcgccgtgcttcgccgcgcgcgctcagtcgaaaccgacgccacgagcgcgcccgtcatgcagatggccggtcgcacgcgtcagcctcctgatcgagacgaagctcgcgaagcccatgccgaagcagcaagccgccagcggccacgcggtagccccgtcgaacaccaacgtcgcaagcgtgcccacgccggtgacgatcacgctctgcaccgcgtaataaagcgccactgccttgccggcgacatcgccgaaatcgcgcagcgcaccgtttgccgtcaccgccgacatcagcacgatgccgaccgcaaccagccacatcggcatcacgaacgtcgcaaacgacggcttcgtcaggatcgtgccgagcgccagcacgatcgcgcccgccatcatcgcgaccgcgcctcgcgccacgcagcccgcctcgccccacttcgacacgaatctcccggcgaagcgcgagacgacgaccatgacgatcgcgacagtcgcaaaggccacgctgaacgacacgcgcgagtaaccggccacaccgaccagcacgcgcggcgcggtcgagaagaacacgaagaacgcgcccatcgaggccgcaaacgcgagcgtgtgaacccggaacggccggctgccgagaatcgatgcgacggacggcccctgccggtttgccgtccgcggacgcgtttcgtgccagcgcggccacgcgcgcccgcatgccagcagccccagcaggccgagcatcgcgaagatcgcgcgccatccgcaggccgtcgcgatggccgcgcccagcagcgggcccaacgccggcacgaacgccagcatcgcgccgaactggctgtagatgatgcggccttcggggcgatcggcgtagacatcgcgaacggtcgcgaacgtggcgacgagcgccgccgcggcgcccagcgcctgcagcgcgcgcagcacgacgaacgggacgccgccggtggtgaccgcaagcgccaggaagctaccgcaaaacacagcgcgccgcccagcatcaccggccgtctgccgatgcgatccgacaacgggccgaagatcatctggcccaggccgaggacgaccatgtagacgctcagcgtcaactggacgacggccggcgacgtgccgagcgcggacggcatctccgggatcaccggcaggtacacgtccatcgccagcgaagcgaggagatcgaaaggggccatcagcaggagcgccgacggcaacgaatgggcccacacgggcgtggattgttcaggcatgacaaggcatccgctcagaaagggaaatctggcggcgatctgcctggtcagcgatggacaacggagatcgccgcaacgaccggttaacgaaggtcgttgcggctcagcgatccgtggacgggccagctcccatggaggaatccttgcgtggtgcgttttacgttgaccgtgcagtgtagtcggttcgccaggccggcaccagccgggcgcgcggtgcacggcagcgactgtccggccggccctccgctcaagccacgacacgctcccatgcggccaattgtcgcgaaacgatgcgattctccgcgtttcgtcgcttttctccaccgatacgattgcccgctcccgacgcctcgcgtatggtgctggccgtccgcgcccgatcggtcgcccggacacccgaccgtcgtcgcgcacgacggccgcgcgggccgtgcccgccgtcaccgtctccgcggcaccgcccttcggcgccgcgcattcatgaggagagagacgtgattcacaaagtcctgatcctgttcgcactctgcatcgcgggcctcgccgcgatcgccgccggtttccagcacatccccagctgattcgcggccccggctcgcttcgccgggcccggggccgcacccattcctctcctcttgcaatgaaccactttctcggaccgcccgggacgggcgcctttgccatgcgcatcgacgtacagcattcccagcacgacatcgacgatgaactcgactcgctctacgcacgcctgcaccagccgggccatcgcctgcacggcctgccggccgtcgcgctcggccgctccggcctgatcgtccgccaccgcgaggccgacggcgaatacttcctgtacgtcgaggatccggccgcgcgccagctcgccggctatacggtattcaaccgcctgcccgaaatcccgcgtcgcgccgaccgctacctgcgcgcgccgcacacgcggctgcgcggatccgcgcaacgcaagggcctcgcgacgacgctgtatcgctggggactcgacgccggcctgtgcctgatcagcggtgcacgtcagtcgatcggcgcggcgcagctgtggaccgcgctggcccatgactatcgacacggcttcgtcgacatcgaaggccgcgcgctgcgctatctcggcgaagccgttgccgacgacgtgcacggcgcgctgcatacgcgtcgtctgctgctcggcaacgggtggaaaatcggcgcattcgcgcgcgcggccgggatggccgacgtcgttgccgcagaatgtcgccacccgggatttccgcgggaaaggcgcgaaccgcaccgcttgcacgggagcgcccaagcgcgtcactccgcccgtgcaccgatgcgataatccgtcgggccggcgcgccccctcgcgcaaaccactcaacgacacgctcctcgatggctaccgaactccaacccgattccgagcgccgcatcgacctcgtcgcgttatgcggcagcctgcgtgcgcagtcgtataacgcggcgctgctggatgcggcggcacgcgtcgcgccgcccgggacgcacatcacgcgcttcgatcgcctcggcgaatttccgctgttcaaccccgacgcggaatatccgtcgcccgccgcggtgcgcgacctgatcgatcgcctgaacgccgccgacggcgtgctgatcgcgagcccggaatacgcacacggcgtgaccggcgtgatgaagaacgcgctcgactgggtcgtgggatgcgaagcgttcgtgtacaagccggtcgcggtgctgaacgcatcgccgcgcgcgacgcatgcggacgcggcgctgcgggaaacgctgtcggtgatgtcggcgcgcatcgtcgagcgcgcgtcgatctcgctcccgatcctcggcagccagctcgacgcggcaggcatcgccgcgcatccgccgttcgcggcggcgctggtcgaggcgttgcacgcgctcggcgcggagattgccgaaggcacgccagcacgctgacgttgcgtaaccggaagtccatcgcagtccggattaatcggacgccgcgcccatcgacgggcgcaacgtccggcacggatcatcgtccgcgatagatcggtctgtcggccgccatcgaacccgattcgctcgcggccggtgctgccattccgtatccgctggtatcggccgccgacgtgccggtcgaaccgaccttcttcaacgcctccgccagccgcgccggatagtacgggtcttcgccgttctggcggtagccggccgcacgcagggcggccagttcggccttcacctccgcgcgcgtcacggtggactgcggcgcggcccacgcggaaacggaaacggaaacggaagcggtcgcggcaaccgtcgcgagaacatacagagcaagcttgttcatctgatctctcctgagcatcgacgatgttgtcgacggagagtgagtcgcgccgcgtgcgcaaagatgacactcgccgaagaagaaatccggcgtcgcgtcacggtgcaggtcccacgcggcacgccggcaggaacggcctgtaacggcgtgttgaacgaaaacccgatcggctgtcagattccgccggctcgcgcgactaccggcatgtggcccggcgccaccctccgttttcgctcaaagggtccgacatgaaaaccagaatctggatactgatcgcgtcgcatctcgcgacggggctcgcggcgtttgccgcgggcatctatgtgctgccgatcctcacggcgacggaaggcgcaagcgccgtcgaactgcaagtggccgcggaaaacgcgcgccataccggccgcttcgaacgcaacctgccgggcagcgacgcgctgcactgggcggacggcaagctgaccgtcaccgattcgtcgatcgcgttcgagggcgacatcgcaccgggccccgactacaagctctatctcgtgccggccttcgtcgatacgcgagcgtcgttcctcgcgatcaaggcgcgcgccgtacgcgtgggcgacctgaagacattcggcaatttcgtcgtggcgcttcccgacgacgtgaatcccgcgcaatacacgtcggtcgtgatctggtgcgaacgcttctcgaaattcatcagcgcggcccgctatcaaagcgcgccggcgtcgggcctgacgtcgatgtgaccggcgcgcggcggcaacggtgcgtgctcgcgcgctaccgggtcttggcgcgcgcgccttcttcaccgccttcgcgcgcggggcttccttctcgggctgcgcgccgccgccggcgagatcctcgagccacgcgagcgcatcgacgtacgacaggaactgctgcaggtattccggcgacagctcgcgcatcgtcgcgagcgaccggtgcacgaggctgttcgaattgagcggccccgcgttgcgcggcacctggtcgagcgactggcggtactgctgttcggtgcggaccttcgaccacatcgtgcggaagtagtcgaccagctcgggatcgagcccgcgccggtcggcctgcgcatcgcggccgagccgttcgacgagcgccgccagcgacgggccgcgtccggccgcaccatcggcggcttgcgcggtatcgcccgcggcggccttcgcttcgtcggcccgcgcgacgaccgccgcgaagccttcgatcagcgtggcgagccgcgcgtcgagcagcccgcgcgcattgccttcgagcgcagccgcacgccgctcaagggcgtcgatccggagaaagcgcacggggtcgagccggtcggcgccctgctcgcgccatgcgtcgagtgtcgcgcgaacatgcgtcgcgtcgtcggtcacttcgcgttccctccgttcgatgccgacttgcgcggcaccggcgcgatctccacgcgacggttcttcgcgcggccttcatcgtccgcattcgagctgaccggctgttccgagccgaacgcggccgcgaacaccgacgacgccggcacgccggcgtcgatcatcgcacgcgtgaccgtcaacgcgcgcttggccgacagttcccagttgtccgcgaactggcggttgccggcatgcacctgctggtcgtcggcgaagccgctgatcatcaggatctcgtcgcgtgtcttcaggtaggcggcgagcggtgcggccagcgtcttcagcaggtcgcggccggcgggctgcaactggtcggagttcagcgcgaacagcacgttgccgctgatgccgatgcgtccgttcacgagcgtcacgcggccggccgcgagcggcccggcgagcgcctgctcgagcgacttgcgctgctgcgcttcctgctggcgcgcgcgcacggcttcctcgagcttcgacgtgagctgcaactgcatgccgatcacgccgacgaggatcagcacgaacgcgccgagcagcaccgacatcaggtcggcgaacgcgggccacaccggcgcggaggacgcgccgccgtcgatttcgtcgtgcatgcgttacgctccgacggacgcccgccggccggcgagctgctgcaggtcttcgacgatctgcttctgcgacatcatgctcaggtcgatcacctcgcgcgcctgcgcgacatagtattcgagctgctcgtcgctgcgcgcgagcgacttctcgagcgcggcctcgatgcgttgcagatgggtcagcagcttgtcgttcgactcgccgaacacctgcacggccatcccgaacgcatcgccgaggctcgcgacctcgaccgcgcccgccgtcacttgcgcggccaccgagtcgagcttgcgcgtttcggcgtcgacggtgtcgttgaagcgtgccccgacgcggtcgagcaggtcggccgacgtgctgacgagcgcgtcgatcgcggtgcgctgttcggtcgacgcgtgattgaccgcgccgagcagcgtttcgagcgtcgcgagcaggcggctgcgttcctcgagcatcgcggtgtcgtgcaccaggctgtcggacaggcgctggcgcagctcggcgacgacgtcggccgcggccttcggcgcctccgacgcagcctgcacgaggcgcgcgatctcgttgatcgtgtcgctcgcatgcacttgcgcctgcgcggtgatgtcgttcgcggtgcgggccagcgtgtcgcagatgtcctgctggcgcgttgcggcctgcgcgctcgtgtgcgcccattcgtcgcgcagcgcggccgccatcgcggcgagcgagtcgttccacgcggcgaggcgttgttcgtcgcgggcggccagttgcgtctgcaagcccgtgtgcgactcgcggatcgtcgacagcaggtcgttcgagcgttgttcgaaagttgcagcctgtgcggtcaggtcgcgcgtcgtttgcgcgagtgcgtcgcagatttcctgctgacggcccgcgctgtgcacgcctgcgcgttgccattcgtcgccgagcttcgcggccatcgcggcgagcgattcgttccacgcggtgaggcgctcctcgtcgcgcgcggccagttgcgtctgcagacccgtgtgcgaatcgcggatcgtcgacagcaagtcgttcgagcgctgttcgaaggtcgaagcctgcgcggacaggtcgcgcgtcgtttgcgccagtgcgtcgcagatttcctgctgacggcctgcgctgtgcacgcctgcgcgttgccattcgtcgccgagcttcgcggccatcgcggccagcgaatcgttccacgcggtgaggcgttcttcgtcgcgcgccgccagttgtgtctgcaaacccgtgtgcgaatcgcgaatcgtcgacagcaggtcgttcgagcgctgttcgaaggtcgaagcctgcgcggacagatcgcgcgtcgtttgcgccagtgcgtcgcagatttcctgctgacggcctgcgctgtgcacgcctgcgcgttgccattcgtcgccgagcttcgcggccatcgcggccagcgattcgttccacgcagtgagacgttcttcatcacgcgcggccagttgcgtctgcaggccggtgtgcgactcgcgaatcgtcgacagcaggtcgttcgagcgctgttcgaaagccgaagcctgcgcgctcaggtcgcgcgtcgtttgcgccagtgcatcgcagatttcctgctgacggcccgcgctgtgctcgcctgcgcgttgccattcgtcgccgagctttgcagccatcgcggccaacgattcgttccacgctgtgaggcgccgttcgtcgtgcgcagccagctcggtctgtagccccgcgtgcgactcgcgcatcgcggcaagcgtcgcgcccgaatggcgttcgaacgtcgcggcggcctcgcccagcgcacgcgcatgctggccggccagcgtctcgccgacctgctcctggcgcgccagcgcatcgcgccaggcatccgacaggcggctttcggtcgattcgaggcgcgtcgcgacgccgtcgagcaggtccgtcgaacgctgcgcgaaggtctcggtgaactggccgagcgtcgtctgcaactgctgcgcgacggcgtcgcccgcacggcgctgttcgtcgagcgcgcggctccagacggccgtcacgttgccggtggtcttctcgaagccgtccgtcagcccgtcgagctgacgctgcacggcgcccgtcacggtgtcgcgcagcgcggccatctcctgcgctagccccgtcatcgtcgcggcgatgaccggctgcagcgcggcaccggccacgcgcgcgctttcggcggcgctttccttcagcgcgtccccgacattcgacgcgaggcccgcatacgcgcgctcggtccgatcgaagaacgcttgctggctctcgatctggcgatcgtgcagcgcgacgctgcgcgcctcgagcgacgtcatcatcgtctgcaggcggtcgaccagcgccggcatcacgtcggcctggcgctgcagcaaccggaacgattcgtcgcgctgatgcgcggacgagtacacacgcaacgtcgtcgcgatcttcgcgtcgagctgctgggccgcgtcgacccgctcgcggcgcacgagcgcggacagcaggccgagcatcgcggacgccgcgacgccggcaatcgacgtgccgaatgcgaagccgaggcccttcaccggcgcgatcagcgacgcgcggatcgcgtcgagatcggtcgcgctttcgagcgcggcgcccgtgcccttcagcgtgacgaccatcccgagcagcgtgccgagcatgccgagcagcacgagcaggccgacgagataaggcgtgagcgacgggcccggcagcgcgacgcgcgcgccttcgacccgcgcacgcacggcgccgcgcaggcccgggtgcagcgtgtcgagccacgtgtcgagcttcgcgggcggctcggtcaggccggcgaccgcgtgcgacagcgtggcggtggcctgccggtagcgcagcagttcccatgcgccggcgacgtagcacgcggcgatcagcagcgtgacggccgacgccagcgggttcgacgcgacatagccgacgccgatccagcccacagcgagcagaccggcgacgaagacaacgagatcaaggcgaattctggacatagcgtgttgattagcaggtgcgaagggccgcgagcagcccgtctaccgtttgaaaccggacttcgagttcggcaagcaggatgctttgcatctcgtcgcgaaacgtatcgagccatgcgccgggcacgatcgccgcgacggccgggctgttgacgatcgccgcgccgtcatcggcgggatcggccgtggccgcggattccgctgcggctgcggccgcggcttcggcatcggccagcgcctgccgctccgcgtcgcgcagccgcccgaagcgcgtaccgagcagcgcgggcacggccgacagcaggctgcgctcgcgcgcgccgagcacgcgctccatgatcgcgtcgagcgtcgcgagccgcgccatcccggacgagcacgcggcgagcgcgacccgcaggcgcccacgcaactggccgatcgccgtttccatgtcctgctgcagggacaggtaacgctggcggaagtccgcgaaatcggccgtgtcggcggccggaggcggcggatcgccgggccggcgccgcgcacgcggccggttggtggccgtgatcgcctgcgcgagctcgtggcgcacgcgcgcgcagtcgcgctccgcgtcgtagccgcgtacgccggccgcgacgccgggcgggctcgcattcagcgcggacgacagcgtgatcgcgtcggtccagccgagccactggctcagccggtcggacagcgtctgccgggattccgcgacgtcggcatcggccaggcgcgcgagcagccggacgagcgccgggccgctcagcgccgggcgcgaaggtgcttgcaccatgctgcaaaccgtcaaaaaggcagcagtttacacgtcgcagggaggtcgaccgccagaatcgggaagcgccaccgcccggtggcgcgtgcggcactcgcgaacgcccgccacacaaggcttggcgggcggccgagggctgctgccgcgacggctctgccgcccttgcccgccgccgcatcgcccgccggttgcgaattcgggccgccgagacccgccgcgttgcgctaccatcgcagcacccgtcgggccacgcgtgccggccgcgggctgcgccccgagaccgggtgccaccgacccacaacgaacaacaaacgggcccggcccgaccgcacacgatgcttgccaacctcgtcacgcgcctgcgcgaccgtttcggcaaaccgccgaccccgcaggccttcgccgaacgcctgatcgccacgctgcgcgcatcgggcgacacgcgcacctggcgccacgaggacgagaagggctgtctcgtccagtcggatgctccgtcgaccatcatcaacctgcacaacctgttccgcgactacgcggccgcgaagccgtccgagcgcgacaccgtgctgaaacggcaggcgaacgcgatgatgcagcacgagatccccgaggatttcgcgccgccgcgcgcagctgcggcccataatccgcagcgcgaccgagcgcggcgtggccgcactgcaactggccgggcagcccggcgtaacggaactcgcattccggccgctgtgcgagaacatcgaaatcggcatcgcgtacgacggcgagttcaacatcgcgcgcctgccgacctcgacgctcgacaaatggggcgtctcgttcgacgacgcgtgcgagatcgcgatcgacaacctgcgggccgaatcgtcggcgccgtgggccgcgctaccgaacggggtgttcctgtcgcaattcaacgattactacgacgcggcgcggctgctgctgaccgacctgctccaccggcagccgatcgccggcgcgccggtcgtgatggcaccgaaccgcgcggtgctgctgctcaccggcgaccgcaatccggccgggctcgccgccatggtcgacctcgccgaacaggcgcaggcgcagccgcgcccgctgccgccgctgatgctgcgctgggacggcaccgcgtggcggcgtttcgtgccggaagggctcgaaacgaagctggccgcgctgcgcatcggcgagctcgcgggcgactaccaggatcagcggatgctcctcgacgacgtgcatgaacgcgacggcaccgacgttttcgtggcgacctactcggtgtacaagcgccaggacggcagcctgttcagcgtcggcgtatggagcgacggcgtgcacacgctgctgcccgagacggatatcgtcgcgctccatcgcgagtcgaccggacagtcggcctacgtgccgctggccgagctgctgaacacgtgcggcgacctgatgacggccaccgggcatcgcccggtgcgttatgaagtgaaggtgtttcccgacgacgcgcggttcgcggcgctgctggagcggttcagcgaagcctgatgccgaagcgcggtgcgcgccggcagcaagccgctggaatggccggccgccgtgcgatgcagatcaggaatggaagcgctcagattcccgctttcggcgcgttcaggatcagccgcagcccgagcagcgtgatcgcgccggccgcgacgcggtcgacccacttcttcgcgcgcaggtagagctcgcgcggccggcgcgtggagaagcacagcgcgacgatcgtgtaccagccgaactcgacgccgaacacgagcggcggcagcgccaggtagcaccacagcggcggatgctgcgggagcagcgccgcgaagatgctgccgtaccagattgccgtcttcgggttgctgagctgggtcgtgaggcccgtccagaacgacttgcgcgcgctgccgccgcccatcgcctgcggatcgtccatcgcgatcggccggtcggcgccgcgccagatcttcgacgccatgtagatcaggtacgcgccgcccgccaccttgaggcccacgtacagccattcgacggcctgcagcagcgtgtagagcccggccagcgcgacgccgccgaacacgatgccgccgatgcccatgccgagcgcggtggccagcccgtcgcggcgcgacagcccgatcgcattgcgggcaaccagcacgaagctcgggcccggaatcatcgcgccgagaaacagcgcagccaggatggcgagtacggcagccgatgcggtcatcgaaatctccttggtgagcgacgccgaagcgccggcgcctgcgtgtcgtgtccgacggtcgagccgccgattctggcacgcttcgcgcatggccgaaagccgccttgcgctgctatgctggccctctttcccgtcagtcgcgccgcccgccatgatcgagatccgcgccgcccgtcgcgttcaatccggtgccgggcgccgcgtttcgcgggcgggaattgtcgccccgtgcgatcggccaccctcttcctcttttcgaccggacaccccgtcatgcgcgttttccacctgcccatcgtgctcgccccgctgctcgccgtgctttcgcccggcgcccgcgccggcgacctgccgaagtcgatcgccgcgcagttgccggccggctaccagccgctgctcgcgcaagccgggccggatctcgacaacggacggcacagcttcgtcgtcgtgcaccgggcggtcgatacgcgcgagcagccgtcgccgcgcccgctgctgatcttcgaggagcaggccgaccacgcgttccggctcgccgcgcgcaacgaccaggtcgtgctgcgcgcgaacgaaggcggccagtgcgatccgttcgatcccgatgatgccgccgacaacggcttcgcggtgaaaggccgctatttcaccgtgcagaacttcgtcgcgtgcggacagcactggaccgactacgtgacgtttcgctacgacccgcacacgcatggctgggtgttttcgaaccggatcgtcaccgaatcgtttccgctcgacgaccagcccgatcacgtcaccgtcacgcgcgcagacgcgcaccggccggtgtcgttcggtcagtggcaacgcaaggactgacgcggccggcgcaacgcgtcgcgaccgcttgcatcgcacaccggccggcgcgggcacggccgggcccgggcacgcgtcgccgcctccgccccgccggcgctcgcgagcgcacgccaacaggactaccataggcgctcgccgtcgcgcgaccgtgcgccggcctcgcacgcggctcgcccgcacgcgttccctcgctgcacccgcacaggaggacgtcatgacgcaacacttcgacgcgatcgtcatcggcaccgggcaagccgggccgccactcgccgcgcggctgtccgccgccggaatgaaggtcgcgatcatcgagcgcggccgcttcggcggcacctgcgtgaacaccggctgcatcccgaccaagacgctgatcgcgagcgcgtacgccgcgcacctcgcgcggcgggccggcgaatacggcgtgtcggtcggcggccccgtcaccgtcgacatgaaagccgtgaaggcgcgcaaggaccagatctccggccgctcgaaccacggcgtcgagcaatgggtgcgcggactcgcgaacaccaccgtgtttcagggtcacgcccgcttcgagcgcgccgatgcggtgcgcgtgggcgacgcgctgctcgaggcggaacgcatcttcatcaacgtcggcgggcgcgcgcaggtgcccgcgatgccgggcctcgacacggtgccgtacctgaccaactcgacgatgatggacgtcgacttcctgcccgcgcacctcgtgatcgtcggcggcagctacgtcgggctcgaattcggccagatgtatcgccgcttcgggtcgcgggtcacgatcgtcgagaagggcccgcgcctgatccgccgcgaggacgaggacgtgtcgcaggccgtgcgcgagatcctcgaaggcgaagggatcgacgtgcagctcgatgcgacctgcctgagcgcacggcgcgacggcgacggcatcgcggtcggcctcgactgcgcgggcggcggtcgcgaggtcgcgggctcgcacctgctgctcgcggtcggacgcgtgccgaataccgacgatctcgggctcgaccgtgcgggcgtcgcgaccgatgcgcgcggttatatcgaagtcgatgagcagttgcgcacgaacgtgcccggcatctgggcgctcggcgactgcaacgggcgcggcgcgttcacgcataccgcatacaacgactacgagatcgtcgcggccaacctgctcgataacgatccgcgcaaggtgtccgaccgcatcacggcgtacgcgatgtatgtcgatccgccgctcggccgcgtcggcatgacgctcgcggaagcgaagcagacgggccgccggctgctcgtcggcacgcgcccgatgacacgtgtcggccgcgcggtggaaaaaggcgaaagcctggggttcatgaaggtgatcgtcgacgcggacaaccatgcgatcctcggcgcgacgatcctcggcgtgacgggcgatgaagtcgtgcacgggatgctcgacgtgatggccgcgggcgcgccgtacacgacgatcagccgcgcgatgcacatccatccgaccgtgtcggagctcgtgccgacgctgcttcaggatctgcatccggtcgaatgacgcgcggcccggcgggcggccgcgcacgctgaagccgctgatcgaccgcacgttcgcgttcgacgacatcgtgcacgcgcatcgatacagggaagccggcgcgcaggtcgggaagatcgtcgtcgcggtctgaaggggtcatgcgggcggcgggcgcggccgttgcaaacggccgcacgaccgccgccggctcagccttcgaaataccgcggccggtcgatatcggccagcagccccggctgcgtcggtgcccagccgagcgatgcgcgcgtgcgctcgctcgttgccggcgcatccatccccgcgaacatcgcgaaccagccgaagtgctcgccggcttcggccgccgttttcgcgacgaccggcacgtcgagccgccggccgatcacgtccgcgatgtcgcggaacggcacgcccgtatcgtcgaccgcgtgataacgcgcgccggccgcgccgcgttcgaccgcgagccggtacacgcgcgccgcatcgagccggtgcacggcaggccagcggttgccgccatcgccgacgaaggccgatacccccttctccctcgcgaacgcgatcaggcgcggcacgaaggcgtgatcgccgtcgccgtgcaccgacggcggcagacgcacgaccgatgcgtgcacgccgctcgcctccagggcgaccgcggccgcttccgacgcacgcggatagaccgacgacaccggcacgtgcggatcgtcttccgtcgccgcacgccctggcgcgacgagcgcgaggcccgacgtgacgaccagcggccgcgccgagcccgcgagtgccgcgccgatcgtctcgattgcgcgacggtcgagttcgcagttctgcgcgaagcgcgagaagtcgtgattgaatcccgtgtggatcaccgcatcggcggcttcggcgccgcgcgtgaggctgtcgagatcctccagcgacccgcgatggacgtcggcccccgccgccgcaaccgacgcggcggccgcgtcggaccgcgcgagaccgagcaccgagtgcccggcggccacgagttcggcaaccacggcagagccgacgaatcccgacgctccagtaacaaagacacgcatgttcagtacctccggatggcatggaggcttactatctgtcgacggccgctcgcggtgaagtcgtgacggtttaccggtaaacgaactaacaggatatggctgacgcccccgacaacctgctcggcgcgtacctgcgggaccgccgcgagaaactcgaccccgccgcgctcgggctgccggccacgcggcgccgcacgccggcctgcggcgcgaggtcgcgcagcgcgcgcatgtgagtgccgcgtggtacacgtggctcgaacagggcgcggcggcgcgccgtcggccgacgtgctcgaccggctcgcccgcgcgctgctgctgaacgataccgaacgcgagcacctgttcctgatcggtgtcggccatccgccggaggtgcgctatcacgcgaccgaccacgtgtcgccgcgcgtgcagcacgtgctcgattcgctcgacgcgagccccgcgatcgtgcgctcggcgacgtgggacgtcgtcgcgtggaacaacgcggcggccgcgacgctgaccgactacgcgacgctatcgccggaacggcgcaacatcctgcggctcatcttcgtcgatccgcacgtgcgcggcgtgcaagcgaattgggcacgcgtcgcgcagttcgcggtgggcgcgtttcgcgccgacgtcgcgcgcggcggcgcgacgcaggccgtgcaggcattcgtggacgagatgcgcgcgacgagcgccgagttcgacgcgctgtggcgcgaccacgatatccgctcgcacgaggaagggaccaaggagatccaccatcctgccgtcgggcgaatcgcgctcgaatactcggcgttcgccgtgagcggccggcccgaccagacgctcgtgatctttacgccggagacggcggacgatcgcgcgcgcattcgggcgcttgtggcggcccgcgagaaatacgaaatttaacgattcgcgtaacaatcgccctcttcaacaaacgacgaatctcctgattgtgcgacgcgccgtcactatcggcgcgtcgattgtcagcctcgaggcagcgatcccgggttctgacaggcaacacctccaacgccaaagccaatcgagcctcgatgaccgacggcaagcccactccgcctgaccatcgcattccgcactgattcccagtcgaatatttaattttcacctggcgtagcgcgcgcttaccctttcggcatcgcatcacagggccaacggcccctccctggagcaccccgatgtccgaccccggcaccgcgcaagctgtccgccgcccgcatgcggcttccgtgtcctatggcgcgctcgcgctgctggtgctggccggcctcaacctgcgtccgttcctgaccgcgttcggccccgtgctcgacgtcgtgcgcgccgacaccggcctcggctttcgcgcggccgcgctgctgaccacgctgccgttcgtgctgatgggtatcgtcgccggagtcggtgtcgggctcgcgcgacgcgtcggcgagcagcgcgcgctgaccgtcgcgctggcgctgatcgcggcaagctgcacggcgcgcctgtggacggacggcagcgccggcctgatcgcgaccgccgtcgtcgcgggcgccggcgtcgccgtgatccaggcgctcgtgcccggcctcgcgaagcgctggttcgccggccggctgccgctcgcgatgggcctctattcggccgcgctggtgggcggcggcgccttcggcgcggtcgcgagcccgtggctcgccgcgcacggcggctggcatctcgcgctcgccgtgtgggccgtgcccgcgctcgtcacgctcgcgctgtggcgcgcgaaggcaccgcgcgacgccgtgcacgcgacggccgcgacagcgccgctcgccgcgttcgcccgcattccgcgcgcgtggcagctcgcgctgttcttcgggctcagcaacagcggctacgccagcctcgtcgcatggctgcccgcgttctaccgcagcatcggcatgagcccgcaagcgagcggcaacctgctcgcgtggatggcgctgttccaggcaaccggcgcgctcgcgatgccgctgctcgccaaaggttcgcccgaccgccgcgccgtgctgtggctcacgctcgcgctgcaggcggccggcttcgccgggttcgcgacgctgcccgtgttcgcgccgtggttctgggtcgcatgcgtcggcctcggtctcggcggtttcttctcgatgagcctgatcgtcacgctcgaccacctgcccgatgcgcggctcgcgggcgcgctcgccgcgttcgtgcagggcatcggcttcctgaccgtcgcggcgagcccctggctgatcggctggctgcgcgacgcgggcggcggcttcgcgaccgcctggtggatgcatctcggcgtgatcgccgcgatggccgcgctgaacgccgcgttctcgcccgccggctaccggcacagcatggcgcgcctcaccggcgccgcccgctaaagcccctttcgaatccggacgcttctccggccgcttccggcgaagcgtccagccgcccgcgcgtggccgggcgcgggcagtcacgcctgtcggccgccagttcgcttcaccacatacaacatcgaccggtattggagacaatcatgaaaaagctcgttctcgccattgcgctcgcgctgacggcaggcgccgccgccgcgaaggacccggcagtcctgcgcctcggcgtcgaccccagttacgcgccgttcgaatcgctcgcgcccgacggcaagctcgtcggtttcgacatcgatctcggcaatgcgatctgcgaacggatgaaggtgcgctgcgtgtgggtcgagaacgcgttcgacggatgatcccggcgctgaaggcgcgcaagttcgacggcgtgctgtcgtcgatgagcgtgaccgagaagcgcctcgcgcagatcgcattcaccgacaagatcaacaacgttccgccccggctcgtcgcgcggcgcggctcgaacctgcagccgacgcccgaatcgctgcggggcaagagcgtcggcgtcgagcagggttcgacgcaggagacttacgcgcgcacgtactgggagccgaagggcgtgatcgtccgcacgtaccagacgcaggatctcgtctaccaggacctgctgtcgggacggctcgatgcatcgctgcaatcgtcggtgcaggccgacctcggtttcctgaaaaccgcgaagggcgcgaatttcgaattcgcgggaccgccgctgcacgacccgaagacgctcggcgtgggttcggcgatcggcgtgcgcaaggatgacgacgcgctgcgtacgcagatcaaccaggcgcttgcaagcctgatccaggacgggacgtaccagcggatcgcgaagaagtatttctcgttcgatatctacaactgacggacgcgtagcggacaacacgaagaggcgtcacgcatgaatgcgcacgcctcttcttcgttaaccgaacgatatcgactacgccgctcgctgcaacaaatccgtcgcgaaagacctcgcatgctcgacggcttcctgcgcgtcgccgaacacaccgagctgatcccagtgttcctcggccgcatacgtccccttcacggcaagcgcccgctgaacgctcagctgcgctgcgtacttgccgtcctccagcggtcgagccgtcgccaccaccttgtgcggcgggctcgcgcgctccggctgaatcagttcgacagcaccgccggccgtgtcgacgtacatcaactcgttcctggctttgcagtccgggcagtagaagcaccagcccgcgtcctcctgatggggcctgacctgcccgcgagcgagtacggcgcggcattcaacgttttcgcagatgaacggcatggcagtctccgaggttgtttgcggaaaatcctagcatgtccgctgaaggtcaaccaccgtcttcgtcatcgacatggccacggatcgtgtgatgcggatcgccgagacggtcaggctcccccaacctttcacacgccgtacacgcgggtcgaccggatgcgcgcgagcccgacgtcacccgggctaaactgtctgcccgaccgacaaaccgagccatccttcatgttgatccgcgttgcaaccctgtccgatgccatcccgcttgccgaattgaagcgcgacacgtttcgcgaaacctttcttcaggacggattcggcatcgactacccgccgaacgacctggctgcgtacgaggctcgaacctactcggtagaaacgatcacgggccagctcaacgatcccgaatgccgcacatgggtcgctgaaagcgacgacggcacgctggtgggctatgcgcacgcggggccgtgcaagctcccgcacccggacgtcgcagaaggttcgggcgagatccatcagatctaccttcggcgcggtacgcaaggaaccggcgccgggcgcgccctgttcgactccgcactggactatctggcaacggagcggcccggcccggtatggcttggtgtgtggtccggcaacgcgaaggcgattgccttctatgagaaggcagggttcacgcgtgtcggtacgtacgatttcaaggtcggggaatcgaccgatctggaattcatctatcggcgctgaggcggtgggcggaaacgcgggcgcaatcgacacgctgcggccaaccagggcatcgccaacgattcggcggcgttgccgaacgaacaggccggccacgccggcccgccaccgcacgacaacgtccacccgcccgctcagtagcggctgcgcccccacagcgtcttcggctcgtcgagcaaatgacgcaacccgctgcgctcgatcatgattgccgcgacttcgttcacccgttcgagcaccgcgttctcgtcgaccgacaacacgcgccgatcctccatcagcacccgtccgcccaccatcgtcatgcacacgtcggccgcgttcgcgaagcacgtcacgcgatacacgggcatgttcatcggcatcatgtgcggccggaacaggtcgacgaggatgatgtccgcgagcttgccggcttcgagcgaaccggcctcgtgatcgatcgacagcgccttcgccgcgtcgatcgtcaccatctccagcaccttgccgtgcggcagcacgtccgggtcgcggaaatgccggcggtggtaatgcatgcactgccacatgtggcggaacatgtcgtagccgcgatcgggcgccgcaccgtccgacgcgatcgccaccgtcacgcccgcatcgatcagctcgggcaccgggcagcgcccgatgatcgacatgatcgcgctcgggttgtggacgatcgcggtgcccgtctcgacgcacgccgcgatgtcgtcgtcggtcaggtcgatgctgtgcgacatgaacgacgtcgggccgagcaagccgagctcgcgatgcgcgaacgcgagcgtgcccgcgcggtggccgtcctgcgtgaacgtcagcccgcgctcgcgtgcgagcgcgccgtagcgtgcggcctggtcgcgaaagtcgtgctcgtaccgcgcaagctcgggatcatgttcgggcccgtacacgggcagcgtgagcgcgatgcggatccggccgtcggcatcgccgtggcattcgtcgacgatgcgctcgcatacgtcgaacatcgtgtcgaaaccgatgtcgcgcgtgtcgctgccctccggcgtgtggcgcgtataggcacgcggcgcgggcggccgcgacgggccgaccgcgacgatcgagcgcgtaccggtgcgcacgaccgcgtcgcaatggcgccgcgcgtagaccggatcgtcgacgcgcatgatcgaattgccgccgccgagcagcgacacgccggtcgtcacgccggccttcaggcgttcgagcgcggcgagatgcgattcggcttcccagaacgcctcgtcggacgcgcgcgtgtagatcgtctcggccgcggccgaccacgcatcgccgtccgcgccgccgatcgtgcgcagcatcgcgtggcccgcgtgcgcatgcgcatcgatcaggcccggcagcacggccttgcggcgcgcatcgatcgtgcgcgcggcacggtaacgcgcctgcagttcatcggtgccgcccacggcgacgatgcgctcgcccttgaccgcgaccgcgccgttctcgatcacgcgccgctgcgggtccatcgtgatcacgcagccgttcgcgatcagcgtgtcgatcgcttcgcggtcgtcctctcgcatgccctcgttaatcattgttcagtgtcctgttgtggttcgatgggtcttgctgccatccagtggccgagagtggccgagcggccgggccgccgggctaaaccccggcggcccggcgacggcgtcatgcgcgaaaaaccgtcacgccgaaccgaccggcgcggcgacccgcgccttcagcttgcgctgcaccgcgctgatcacgacgaacaccagcgcgttcaccgcgagcgcgacaagccccgggttgatcgacgtcagcgtgttcgatgcgcccgggaacagcgacgcgagcgtcacgccatagtagttcgtcatcgcgatcacgatcgcgccggcgacgatgcccgcgaacgcgccttcgcgtgtgccgaacggccgcttcaggaagctcgaggcgagcatcggcacgagctgcgtgagcaggctcgacgagaagatcgcgagcgtgacgaaggtcgcgccgccgcgcagcacgaagtagacgaccaccagcgtgaagatcggcagcgcgatgcgcgcgacgcgcgtcacctcgcgatcggtcgcgttcggcgcgaagccttcgcggtagatgttgcgcgcgatcgtcgtcgatgcgttcagcatgatcagcgaccccggcaccagtgcggtgagcagccccgtgccgccgacgatgccgacgaaccacgcagggaacgtctgcttcacgagccgcagcaaagcgagatcggtctgcgcgccttcgagcccgtgcacggtcatcacggccgcgaagccgacgaggaacaggaacgcgatcagcacctggtacagcggcatcaggatcacgttgcggcgcagcgcgcgctcgtccttcgcgacgtagatcgcggtgaagccgtgcggatacaggtagtagccgagcgacgtgagcaggatcgtcgagttgtaccagctcaggttgaagccgtgctccggcatgcgcagcagttcgggatgcgcggcgtcgatcttcgcgaacatctcgccgagcccgccgtagtagtgcatcggcaggtacaggccgaggaagatcgcgatcgcgaggatcagcacgtccttgaagatcgcgatgctcgccgagccgtggatgcccgacacgaccatgtacacggccatcagcgtcgcggcgatccagatcgcggccgcctgtggaatcagcccgtacgacatctccgacacgatcacgccgagcccgcgcaactggatcatcagcagcgacaccatcgcgaacaccgcgacgatcgacaccagcacgccgatcgcgcggctgtcgtacttcgacgcgaagtagtcggcgaacgacacgagcccgtgcgccttcgcgtaacgccagatcgccggcaacatccagtagccgatcacgaacgcgaggcagccgtacgacaggatgtagaacgccggcacgcccttgctgtaggtccagccgctcgcgccgaggaacgagaacgtcgagaacgcctcgccggccatcagcaggaacgtgagcagcgagccgaagccgcgcccgccgaccgcccactgctcgagcgtgagcttgcggccgcggcgcgccatcacgccgatggcgagcgcgaacacggcgaacgccgcgatgatgacgatcgacgcgttcatcgcgcgtctcccgagcggccggcgcgggccgcgtcgcgcgcgtctcgctcatcgcgctcgtcgagatggaacaggattgcgagaatcgcggccgtggccgccatccagaccaggttccagacgagcaggaacggcagcccgaacagcagcggacgcgcctcggcgagcgagccgcccgcatacatcccgacgaacggcaacgccgccagcaacagtttcagtttcatgagtgcctcctccggaagacgcgcgtgtgcgtcagaacatcagaacttctggcggatgccgaccaccaccgccacctgcgacgtcgtcgtcgacgcgctgtcggtgccgtcgatccatgcctggccgacacccgacgacgccttctggtagaagccgttcacgtacacgtcggtgcgcttggacagcaggtactgcacgccggccgatacctggtggtaatggccgctttcgccggcgcgcgcgacctgcgtataggtgtagccggccgccgccatcagcgcgggcgtgaccatgtaacgcaggctgccttcgtagttgttgaaacgcagcgcgccgcccgtcgcctggccgaagttcgagcccgatcagcaggccgagcgttgccggcccgatcgcgtagctgccgcccgcccccagatctgctggcggatcgcgctcccgaggcgtgcaccgaacaccgatgccgacgccggatagtagttatccgaagcaactgcgccgctcgcgctgaccgccggatggtttacgcgcgcatacgcggcgcccgcgttgagcggcccgttcacgtacgtgacgcccgcgctccagctgttgtcgttcgcgaaaccggtcgagttcgagaagccgtatacgaggttcgcctgcaggcccgcgatcgtcggcgacacgtacttcaccgcgttgttgagacggaacgtgttgttgatgtcgtcgttgtcgaacgggtgcgtcgagtattgcgcaaggaagctgctcatctgcagcgagccgaggatgtcctgcgtcgagttgtactggcggccgagcgtcaccgcgccccagttcgcgccgctcaagccgacccacgccgaacgcccgaacatccggccgccctgcccgagcgcgccgttcgcgacgttgaagccgttctcgaggcggaagttagccttcaggccgccgccgagatcctcggagccgatcaagccccagcgcggccccgattcgttgccgcccgtgaactgccacagcgaatggcccttcgcgttgttcgtgtaggtcacgcccgcgtcgacgatcccgtacagcgtcaccgtcgactgcgcgtgcgcggcgccggcgagcagcattgcgatcgcggcgcccgtcttcccacccttcattcgcaccatctccgtcatctcctctccaaacctgctcatcgatgttgtgttttgttggtcctgcccatgcatcccgaccgggttgtatagacagtcgctggatggtatccagccgcaatcacatcaagaaatgaaatgttcaactggccggcagttgaaaatcgaatgagaggcgatggagggaaatgagcggggtcgcgcgaccccacaagggaaacgaaagcacgcaggcccgctggacgcggtacgttttgatcggacgtgaatggcttgcgtaagcaagctgacgaaacggcgacgcgcgaggcggctatgcggttttccctgacagcccgtgcatcggccgccgcaacgcggcatcgaacggattggtacgtggcccgatcgcgtcggcctggcgccgcagcagttcgacgaccatcggcatccggtcgtcaccgaggcgtgacgcgagcgtgccgacgctcaacgcgccgaccggatagccagtgcgatcgaggatcggcaccgcaacaccggccatcccgtcgagcacgccgctgttgcggcccgcgtagccgagctgccgcacgcgttcgatctcggtacgcaggtacacctcgtcgagcacgccgtagccgcgaatgcgcggcacgttgaagcggatcacttcctcgcgttcggcttccggcaggaacgcgaggatcgcaaggctgccttgtccgacaccaagcgcgatgcggccgccgatgtcgccggtaaacgaacggatcggaaacggcccttcgcacaggtcgagacacacggcgtcgaagccgctcttcaccagcaggaagatggtctcgccgaggcttgcgcacagcctcagcagcgcgggacggcacaacgtgcgcatgctgctcgggttgccggcctgcgcggcgagcgcgaagaaatcgacactcaggcggtacagcttcgactgctcgtcctgttcgaccatcccttccgcgatcagcgattgcaggatccggtgcgcggtgccctgcgtgaggccgacggcctttgccagatgcgtgacgcgcacaccgtcctgctgcatgccggccagcgcgcgcaggatcgcgaacgcgcgttgcagcatgccggtgcccggtgcgccggccgcatcgacggcgtcctcgtccgggcgcggcgcgcgtgcgaccggcgacgttccggtcgaatgggattcctgcatgccggctctcctcgatgatttcattgaacggaatacggtagccgccattgtcgtcccgccgaaattccacgggcatccgggtgtgcacgggattgacgcgtgcatttcgcggctcggccacgcctcattcaacggaacgatccgcccgcgatttcgccaactgttccggtcaatggaatttttccgaaattcctcccgttcatcagaattcgaaattgacgcgccgaaatatggctggctagagtccgccacatcggtacaccggccacgcggtgtgcgaacccggagcttcccatgtcgtttctcacgcttacggatctgacgaaaaccttcggcgaactcaccgccgtcgccgacgtcaacctgtcggtcgaacaaggcgaattcgtgtcgctgctcgggccgtccggctgcggcaagaccaccacgctgcagatgatcgcgggcttcgtcgacgtcacgcgcggccgcatcgcgctcgacgggcaggacatcacgcacctgaagccgaaccggcgcgggctcggcatcgtgttccagagctatgcgctgtttccgcacatgagcgtcgccgagaacgtgggcttcggcctcgacatgcgcggcgtcgacaaggccgagcgcgccgagcgcatccgcgcggccctcgcgctcgtgcgtctcgacgcgctcgcgcatcgcttcccgcgcgagctgtcgggcggccagcggcagcgcgtcgcgatcgcgcgcgcggtcgtgatcgagccgccggtgctgctgctcgacgaaccgatgtcgaacctcgacgcgaagctgcgcgaggacatgcagttcgagctgcgcgcgatccagcgcaagatcggcacgacgacgatcatggtcacgcacgatcagtcggaagcgctgtcgatcagcgatcgcgtggtcgtgatggaagccggccgcatcacgcagaccgatacgccgtaccgcgcgtacgaacgcccggagaaccgtttcgtgtcgcagttcatcggcaaggcgaacctgctgcccggcacgatcgtcgcacacgacggcgatgcgatccgcatcgacctcggtcacgatctcgccgagaccggccgcaccgcgcatctgccgccgcgcgagcgcgacgtgcgcgtgggcgatgcggtgtcggtctgcatccgccccgaaaagctgcggctgtgcgcgcccgacgcgggccgcttcgccgcgaccgtcacgagccgcttcttcctcggcagccagtggctgtaccgcgtcgacagcgcgctcggcgaagtgctcgtgtgctgccagaacgaaggggcggagccgctcgcggaaggcgcgccggtcgggatcgactggcacagcgacgcggtgcgcgtgatgcgccgggaggcctgaatgggacagcctacccgtccgctcccgaccgacggcgcgccggccgcgctcgctcgcccggtcgcggtttccgctgacgccgcaccggcacgcgccgccgccgcgcacacgatgcgcgcgacgtggcgcgcgcatgcgccgctgtggctgatgtgcgcgcccgcgttcgcgctgtttgccgcgctcgtgctcgtgccgctcgcgatgacgttcatgctgacgttctaccgcttcgatccggccaccggcccgatcgccgcgttccagttcggcaactacgcggaagtgctcggctcgtcgtacttccacacgatcttcgcgcgcacgttcggcatcgccgcgctgaccaccgcgatctgcgtcgcgatcggcacgccggaggcgtacgtgctgtcgaaaatgcgcgacccgtggcgctcgctgttcctgctcgcgatcctcgcgccgctgctggtgtcggtcgtcgtgcgcgcgttcggctggagcatgttgctgaacacgagcgggctcgtgaaccaggcgctcgggctcgtcggcctcgggccgtacaagctcgaatacacgaccttcgcgatcgtgatcgcgctggtgcacgtgatgctgccgttcatggtgatcccggtgtggaccgcgctgcagcggctcgatccgcagaccgagcatgcggcgctgtcgctcggcgcatcgccgttcacgacgctgcgccgcatcgtgctgccgcagctgatgccgggcgtgctgtcgggcagcctgatggtgttcgggctgtcggcgagcgcgttcgcgattccgggcctgctcggcggacgccggctcaaggtcgcggccacggccgtctacgacgaattcctcggctcgctgaactggccgctcggcgcgacgatcgccgtgctgctgctggtcgcgaacctcgtcgtgatgctcacttactaccgcgtgctcgaacgccgctacgcgcgcagcctcggaggcgcatcgcgatgagaaagaatggcccctttgccctcgccttccacacgctcgtgatcctgttcgtgctcgcgccgctcgtgatcgtcgtgctcgtcgcgttcacgcccgacgaaacgctgacgctgccgacacacgggttgtcgctgcgctggttccgcgcgatcctcgactatcccgacttcgtcaccgcgttcttcaacagcgtgaagctcgcgttcgcgtcggcgacgctgtcgctcgcgatcgcgctgccggcgggcctcgccatcggccgcgcgacgtttcccggccgcgcgttcctgaacgggctgctgctgtcgccgctcgtgattcccggcctcgtgctcggcatcgcgctgctgcgctttttcgcgctgatcggcgcgaccggctcgttcgcatggctcgtgctcgcgcacatggtcgtcatcacgccgttcgtgatgcggctcgtgctcgcgtccgtcgcgggcctcgaccgcagcatcgagcaagccgcatgctcgctcggcgcggacccgtggacgacctttcgccgcatcacgctgccgatgatcgtgcccggcatcaccggcggctggctgctcgcgttcatcaacagcttcgacgaactgacgatgtcgatcttcgtcacgtcgccgcagacggtcacgctgccggtgcgcatgtacatgtatgcgaccgagtcgatcgacccgatgatggcgtcggtgtcggcgctcgtcatcttcatcaccgccggcgcgatgctgctgctcgatcgcgtgtacggcctgaaccgcatcctgatcggccaacactgatgacgacttccgtttcccgttccaccggcatcccggacgacggcgcgcagttcgtgcgcgtcgccgaacgcgaacgtgccgccgtcgcgttcacgctggacggccgccccgcgctcgcgttcgccggcgacaccgtgctcaccgcgatcctcgttacgcagcgccgcgtgcgcgtgagcgaattcagcggccagccgcgcgccggcttctgcctgatcggcgcgtgccaggactgctgggtgcgcaccgaaaccggtgcgcgcgtgcgcgcatgttcgacgccgatcgccgaaggcatgcggattctcacgtccgcccggccggccgcgaccggagacgcatcgtgatcgccgcactgcaaccggtgatcgtcggcgcggggccggccggcgtacgtgcggccgaagcgctggtcgacgcggggctgcgcccggtcgtgatcgacgagaacgcgcgctggggcggacagatctaccggcagccgccggccgacggcgccttcgcgcgcggcaagcacacgctgtacggcttcgaggccgcgaaggccgacgccgtgcaccggacgatggccgcgctgctgccgcatgtcgactaccggccgaatacgcttgcctggtcatgcggtgcaggccgcgtcgacacgctgcaggatggccgcgaagtgacggtgccctactcgcacctgatcattgcgagcggcgcgaccgaccgcctgttgcccgtgccgggctggacgctcgcgggcgtctatacgctcggcggcgcacaagtggcgctgaaggcgcagggctgcgcgatcggccggcgcatcgtgttcgcgggcacgggcccgctgctttacctcgtcgcttaccagtatgcgaaggccggcgcgcaggtcgcggccgtgctcgacacgagcccgctgcgccgccaggccgctgccgcgcccgcgctgctgcgcatgccgtcgaccttcgcgaaggggctctattacatcggctggctgcgcgcgcacggcgtcgcgatcgaaacgggcgtcacgctcgagcgcgtgctcggcgacccgcacgtgacgggaatcgcatggcgcgccgccggtgacggcgcaccgccgcgcctgctcgactgcgacgcgctcggtctcggcttcggcctgcgctccgaaacgcagctcgccgatctcgccggctgccggttcgggttcgacccgctcaaccgcgcatggctgcccgagcgcgacgccgccggccgcacgtcggtgcgcggcctctacgtcgccggcgacggcgcgggcatcgcgggcgccgacgcggccgaggcatcgggccggcgcgcggcactcgcgttgctcgacgacgccggcatcgcgtcgcccgcgcccgccggcaaacccgacggggcgacgctcgaacgcacgctcgcgcgcgtcggcgcattccgggcgggcctcgaagcggcgttcgcgccgccggtcgagcaggccgtacgctgcgcggacgacacgatcgtgtgccgttgcgaggaggtcgatgcagggacgctgcgccgctgcgtccgcgacggcgcggcaaccgagctgaaccggctgaaggcgctgacgcgcgtcggaatgggccgctgccagggccgcatgtgcggcgacgcggccgcgctcttgctggccgccgaaaccggtcgcccgctcgccgacgtcggccggttgcgtgcgcaaccgcccgtgaagccgttcccgatctcggccgcgctggcgggcgacgatgtcgcggcgattcccgacgaggcacgcgatgaatgagacccggcgttacgacgtcgcgatcgtcggcggcggcctcgtcggcgcgtcggccgcactcgcgctgacgcgacgcggcttgcgcaccgggctgttcgagcggcgcgattgcggtgcgcaggcgagcggcgtgaactacggtggcgtgcgctgccagggccggcccgccgaacagctgccgctcgcgctgcgtgcgcggcgcatctgggatcgcctgcccgaactgatcggcatcgacggcgaattcgtcgtgtcgggccacctgcggctcgcgcgcagcgacgccgatctcgacgcgctcgatgcctacgcgacgctcgccggcgaatacggcctgccgctgcaggtgatgcgcggcgatgcgttccggcgccgctacccgtggctcggccgtgcggcgctcggcggctcgctgtgcgagaccgacggtcacgccaacccgcgcctcgtgtcgcccgcgttcgcgcgcgcggcccgcgcggcgggcgcggacgtgttcgagcacaccccgtcgacgacgttcaccacgacggcacgcgctttcactttcaggcaggcggccgcgcctgcaccgcgacgtggctgatcaactcggccggcgcgtgggcgaacacgatcgccgaacgcttcggcgaagccgtgccgatggagccgatctacccgaacatgtgggtgaccgaaccgctgccgccgttcatcacgcacaacctcggcgtgtacggcggcggcgtgtatgcgcggcaagtcgcgcgcggcaactgcgtgatcggcggcgggcgcggccgcggcgacggcgaattcggccagccgtcggtcgatacgacgcgcgcggtgatgcgcgatgcctgcgcgctgctgcctgcgctgcgtgacgcactgctgatccgcacgtggagcggcgtcgaaggctgcacacccgaccacaacccgatcatcggcgcgagccgcacgacgccgcgcctgcttcatgcgttcggcttttccggcggcggcttcctgctcgcgccgggcgtcggcgacgtgctcgccgatctcgtcacgaccggcgaaaccgccaccccgctcgatgcattctcgatcggccgcttcttccgcgaagccgagccgaccgcccctttccgtcaagaggagacccacaaatgaaactgcccggaacgatcgcggcggccgccgccctctgcatcgcaggtgccggcgcgcccgcgttcgcgcaaacgaagacgatctacgtcggcatgaatggcggcccgatggagaaggcctacacgagccaggtgctgcccgacttcgagaaggcgaacaacgtgaaggtcgtcgtcgtgcccggcacgtcgtcggacgtgctcgcgaaactgctcgcgaaccgcaacaagccgcagatccacgtcgcgttcctcgacgacggcgtgatggcgcgcgcggtcagcctcggcgtgtgccagaagctcgacgattcgccggtgctgaaggagttgtatccgttcgcgcggatgaaggacgacgtcggcgcgggcgtgcagctcgggatgaccggcatcgcgtacaacaagaagctgttcgccgagaaaggctggacgccgccgacgtcgtggatggatttcgccgatccgaaatacaagggcaaggtcgtgttccagtcggcgtcgagcagcacgttcgggctgcacggcttcctcgcgatcaaccggctgctcggcggcaacgagcagaacgtcgagcccggcttcagcaagtgggcaagcacggtcgggccgaacgtcgtcgagtacatcccgaactcggcgaagatctcggagatggtgcagaccggcgaagccggcctgttcccgctcacgccgaccggcgtcggcgacctgcaggacaagggtatccccgtcgcctacgcgaacccgaaggagggccccgtgctgctgctcgtcgacctgtgcatggtcgcgaacaatcccgatccgcagctcgcgcagaagctcgcgcagttcctgctgtccgcgcccgcgcagacgaaggcggccgaggccggcaagcagattccgaccaaccgtctcgcgaagatgcccgccgcgatgcaacagagcctcggcaatgtcgacgatctcgtgcgcaaggtgaccgtggtcgactggaccgcgatcaacgcgcgccgcgcgcagtgggatacgcgctggaaccggcagatcgagcggtgacggcatgccgggcgcgcaggcacggccgcgcgccgcatgaccatcatttgcgggagtgatgacactccctttttctgcggatttgaccggggacacagggccgacaacactagcccgcagtgccgcaaagacggcacgcgcccgcccccttcagagtccgccatgtacccgaccgacaccgtgcaatccccgagcgccgcccggccgctcgccgaccggcgctgcgccggatcgtcatcgcctccgtcgccggcaacgcgatggagtggtacgactttttcgtgtacggcacggccgcggcgctcgtgttcggccacgtgttctttccgcccggcgcgtcgccgctcgcgggcagcctcgccgcgttcgcggcattcgcgctcggcttcgtcgcgcggccgctcggtggaatcgtgttcggccacgtcggcgaccgctacgggcgcaaggcgtcgctcgtgtggacgctgctgatcatgggcgcgtcgaccttcgcgatcggcctgctgccgacctatgcgcaggtcggcctgtgggcaccggcggcgctcgtcgtgctgcgcctgctgcaaggcatcgcgtccggcggcgaatggggcggcggcgtactgatgatcagcgagaacgcgccgcccgagcagcgcggctactacgcagcgtggagccagctcggcgtgggcggcggcttcgtgctgtcgtcggccgcgtttctcgccgcgcaggcgctgccggacgacgcgttccgcacctggggctggcggctgccgttcctcgcgagcatcgcgatcttcgcgatcggcatctatatccgccgtcatctgcccgaaagccgcgacttcgagcaggccggccggcgcggcgcgcacacgcatctgccgatcgtcgagtgcatccgccgccatccgaaggaaatcctgctcgcgatggggctgcgcgtggccgagaacggcggcgcctacatctttctcgcgttctcgctcgtctacggcaaatacgtcggcatcccgaacggcgtgatgctgaccggcgtgatgatcgcgatgatcgtcgagatgggcgcgatgctcgcgtggggccggctgtccgaccggatcggccgcaagcccgtgtacctgatcggcgcgctgagcctcgtcgcgtgcgcattcccgttcttctggctgctcgacacgcgcgcgacgccgctcgtctggctcgcgctgacggtcggcacggccgtcagccacggcgcgatgatcggcacgctgcccgcgctcgtcggcgagctgttcagcaccgaggtgcgctactcgggcgtcgcgctcgggcatgaagtcgcgtcgatcttcgccggcgggatgtcgccgctgatcgccaccgcgctgctcgcgcgctatcacgtatcgtggcccgtgtcgctgtttctcgtcgcgctcggcctcgtcaccgtcgcgacgctgtgcgtgatgcgcgaaacgcggatcgtgagggccgctcccgctgctcccgccaccggcacgcgcggcgacacggcgtgaccaccacgctgcgatccgcgcaagcgggccgatccgcaccggcaggcggcgaacacggcggcggccggcacggccgttccgggcgcgtgccaccggccgcgcccgccaccccggcgcgccgcctagttgccgccctccgccgcgcgccgtcgaacgccggcgccagccccaggtgatcgagcagccgcccgaattcgccgagccgctgccgcatgtacgcgggcacgtcgaccgccgcgtagtcgtggaagcccgcgcccgtgcgcacgccatcgcgcccggcttccatgttgcgcacgacgctcgcggccggcgcgaaacgcgggccgatctcgccggccaggtaccgcgacgcgtagtacaggatgtcgcagccgccccagtcgatgaattcgagcagcccgagcaccgcgaagcgcgggccgaaaccggtgcggattgccgtgtcgatgtccgccgcgctcgcgacgccctcctcgaccatccgcgcggcttcgttcatcgcgagcgcctggatgcgcggcacgatataaccgggcgccggcccgcagatcaccggcttcttgccgacacgttcgagcaacgcggcgagcgactcgacgacggccggatcggtcgcatcgctgcggctgatctcgacgagcggcatcaacagcgcggggttcagccagtgcgcgttcagcatccgcgccggatgcgcgacgtgacgctgcagctcggtgacgacgaacgtcgacgtcgtcgacgcgatcgttgcatgcgcaccgacatgcgcgccgagccagcgcagcgcgtcggccttcgcatcgagcacttcgggcaacgcctcgaacacgatgccggcctgccgcaccgcatcggccgcaccgtcccgggcgacgagcgcgatgcgcgcgaccacggtttcggcctgcgcggcgtcgatgcggccgagcgcgacctgcgcgtgcagcggcctctcgatctcgtcgcgcgtgcgtgcctcgaaggcacgccatccggccgcgtcgcgcggcttgaagtcgatcagcgtcacgtcgagccccgcgaacgcgaacacgagcgcgatccctgccccatgcgccccgcgccgagcacgtggacgcgcgtcacatcggcgcccgccttcatgctgcgtaccccgcgtcgagcagcgcgcgcatcgcgtccttcgacagcgcggcgagcccgagccgctccagcgtgcggccttccgcatacaggtcgcgcaccgcgaccgcgctcgcaatgctcagcagcccctgcgcgacaggcgtcggcacaccggcccggcgcccgcacgacacgatgaacgacagcccgagccgggtgtcttcgagcatgtagcgatgcgtgcgcagatcgatcttctcgcgccagtcgccgctatcggtcagcttgccgtgcgcgccgcgcccgtacatccattcgtcgccgtcggtcgcgtagtgatcggcgagcgggaaatgcggcgccgggtaaccgagcgcttcgcgcaccgcgatgcgttcggcgtcgagcgcgttcgtcacgcggcggatcgacggctgcgtgccttcgttgtggatgtcccatgcgtcgaagtgttcgagcggcccggcgttcatcaggatcagcggcggatggatcacggggcccgcgttcatcaacgcgccggacaacgcgtcctcgaccggttcgaccgacggataacccgcgcgcagcacgtcgaacgcccagccggccgcgttcgccggaaatacgccggtcggcagccgcgtcgcgtacgcgctgatcacgacgtcgttgtcgccgtgcctgcgcacgagatacggcagcgtgcccgtctcggcgaaggcgacgcgcgaacggttgccggcatcggccgccgcacgcgcgaacacgatgctgccgaacgtgccgggcggcaggaacacgacctggccgtcctccagcagcggcgcgacctgcgcggcgagcgcgtcgtgcgaagtggccggcagcggcaccacgacgagccgcgcgccgcgcagcgcggccgcgagatcgccggtcaggcggatcgcgccgggcgcgtcgccgagcggcaccgtccgctcgccgcgatagtcggtcacgttcagcacgccaagctcgcgcagccgcgcgtgcggctcgcggtcgcgccgccaccatgtcacgtcgtggcccttctcgaacaggtcgatggccgccgcatggcagccgtggccgccgcccagaacacataccttcatcgtcttctcccggtgaatgagtgcttccgagactacgcgtccgcccccgccgcgtcgcttcaaaacgcgcaacggcacgcccgttcgcgcaacgcaatcggggcggcacgcacgaaaccgcgcccctgcatccgatacgaggtccgtgaatggatatcgccctttcccgccatgcgccgaaccggctcggcacgctgcacgcccccgacgaagtcgaacgcgcggtcgcgcaccggctcgggccgcaccggatggccgcgcgcggccgcgatccgtttcatgcggagctgtacgaagtgccgctgcatcacggcgcgctgctcgaactctgctacggccgcgaaacgcgcatcgatttcggcgacgatgccggtcacttcctgttcaggctgacgctcgccggtgcctgcgaactgcaggccggcagcgtcgtcgcgcgcgccggcccgggtgagctgaccgtatcgtcgcccgcgctcgccagccgcctgagcacgagccccgattgccgcaacctcgtgctgcggctcgaacgcggcgcgctcgaacgcaagctgcagcacatgctgcgggcaacgctcacgcggccgttgcaattcgacctcgcggccggcgacgccggcacgggcgccgcgctcgtgctgccgacctttgaatacctgtgcaagctcggcgcacaaccgcgcatcggcacggcctcgcccctcttcggcgccgatctcaccgcatggctgatgtcgctgctgctcacgcacctgccgcactcgtacagcgacgcgctcgcacgcggcacgccgccgttgccggcgcacgtgcgccgcgcgtgcgatcacgtcgacgcgcacctcggcgagccgctcgggctcgccgcgctggcggccgtcgcgggcgtcgcgccccgcacgctgcagcacgcgtttcgcgcgttcctgcacaccacgccggccgcgtacgtgcgcgagcgccggctcgccgccgtgcacgcggcgctgcaacgcggcggcacgtgcagcgtgaccgacgtgctgatcgcgcacggcatccatggcttcggccatttcgcgaaggcgtatgcgcagcgttacggccatgcgccttccgtcaccgcgaggcaatcccgatgacgcacgccgcaaccggccgcccggcggccccgacccgcgctgattccgcgccccacgacagcgacctgtcggaactgcgcgtgcaggatctcgacctcaacctgctgaagacgtttcgcgcggtctacgaggagcggcatgtcggccgcgcggcgctgcggctcggcgtcacgcagccgtccgtcagccatgcgctcggccggctgcggctgatgttccgcgacgcgctgttcgtgcgcaccggcaccggcgtcgagccgacgccgcgcgcgcagcggctggcgatctcggtcgacaaggcgctcgcgatcctgcaggacgtgctcgacgaagggtcgcgcttcacgcccgacagtacgcagcgcgtgttccgcctgcacatgagcgatttcgccgcgagcgcgttcctgccgacgctgctcgccgcgttcgaccgccgcgcgccgggcgcggtgatcgagacgctgcacgtcgacgaatgccagctcaacgtcgcgctcgaatcggggcgcatcgacttcgcgctcggacatttcaccgacgcgtcgagccacttccagcgcaccgcgctgctgcacgagcgctgcgtgctgctgatgccgcgccgcaccgcgcagcgcgtcgcgctccccgacgattacgtgctcgatggcgcggcgcccgatacattgcgcttcgtcgcggtcacgtcgcatccgcaatcgatgcagctgctggagcggcacgggctgatgccgcgcgtgcgcgcggcgctacccgatttcatggtggtgcccgcgctgctgcgcgacggcgactatgcgctgattttgccggagacgatcgcgatcacgttcgcggcgcggcagccgtgcgcactgtacgagatcgccggtgccggcgaatgggccgtcaacgcgtactggcaccggcgcttcgacgcggaccccggccatcgctggttgcgcgcgctgctgctcgaactgttccacatcggcgagctggcgccgttcgacgcatggctcgcgccgcaaccgcccgcctgcgcatgacgacgcgagcgggcagcggcgcgcgccggtcagaacgacgtgaggatgcccgcgacgatcgagctcgcggtcgcgcccggcttggcgaccgcgacgccgccgcccgccgcgccgttgacgacgaagcgcgcatgcgcgccgttgcgcaccatcgcggcgcccgtgtacagcaccgtgcgcttcgacagcggatagtcgaagcggatgccgtacgaatcggcgttgccgtcgctgtccgcgaccttgcggtaatggccgacgctcagcagcagcgacgcacgcccgatcggcaccgtcgcgctcagctccatgatgtcgctgtgcggatacgcgctctggctgtcgatcgcggtcgcgacgtcggggccgccgcgatggcgcaggtacagcgcggcgaccttcacgacattgaagtcgtacgaaatcgcgccgagcgtgtagttgccgttcgcggccgggctcgtgtcgccgagcgcggccgcggccaccgggctgaacttctgctgcatgtagtcgatgtcgaccgacaggccgccgcgcacgtagttgagccccgcgccgtacgtatcgccaagcgtcgccggctgcccggccgcgccgttggtgccgcgcgcggccatcgcgcgcagcatgaggcccgcgtagcgcggcgacgtatagcgcatcgagttgcgcacgcgcaggaacgcgggcccgacgaagttgttcgtcgcgttgccccacgcgagccccgcgccgagtccgggcaggctgtacgtgacaagcgtcgtgtgcaggatcgtgtaaagctcgccgaactgcacgccgccgaacggccccgtgatgccgacccacgcttcgcggccgaacagcgcactgctgttcgacagcgcgccgctggccgcgttgaagccgtcctccagcttgaagatcgtcgcgtagccgccgccgagatcctcgacgcccttcagcccccactgcgacgcgaacaggttgccgctgcccatgcgcgtcacgtggttcggcccggcgttcgcgtattcgatcgcggtgtcgacgcggccgtagagcgtcacgctcgattgcgcgaatgcgggcagcgccgcgcaggccagcagcgcggcaagcggtacggcaagccggtcggcccgcccgttcggttggttcatcgtcgtcgtcccgtagaggttccggcgcctgtcggtatcgcgccggttggtgtgaagcgcgttcgccgcgaagggccaacgcagccgatcaaaaacgggccgagtctaggaacgacaatttcggacgtcgacgcaatgcgctctataacgcttatagatgcgccgcatgatgcgcgcgcgcccgctgcaagcgcgccgcgcggcggccggcgcgcgtcaccctggtgttttctttatccgggtcggtagatgcccgtgtggcgcggctgtcactccggctatggcggccggatttggccgactacgctgcgtctccgacacgtgcccccgcacgctttcgcgccgcgacggcgcccggcccgccaggccgctgccgcgcatccccaccgcccgctcctggagaatccgcatgtccgcatccacggcccgcgctgccgacggcaagcgctatacgtacgaatggtatgtcgtcgtcatctgcatgctcgcgtacgtcttttcgttcgtcgaccgccaggtcctcgtgctgatgatcgagccgatcaagcgcgacctgcatctgtccgacacgcagttcagcctgcttaacggcttcgcgttctcgctgttctatgcggtgatggggctgccggtcgcgtatctcgccgatcgctacgcgcgcccgcggatcatctcgctcggcatcgcgctgtggagcgtcgcgaccgccgcgtgcgggctcagccagcatttcgtgcagatgttcatcgcgcgcatgggcgtgggcgtcggcgaggccgcgctgtcgcccggcgcgtattcgatgctcgccgactacttcccgaaggagaagctcgggcgcgcgatcgccgtgtattcgctcggttcgttcatcggcggcggcgtcgcgttcctgatcggcggttacgtgatcgcgctgctcaagcatgcgagcgcgttcacgctgccggtggtcgggcaggtgcatgcgtggcaggtcacgttcctgatcgtcgggctgccggggctgctggtcgcgctgctgttcgcggcgaccgtgcgcgacccgcagcgcaaggggctcgcgcaggatcgctcgggcgccgtgcggcgcgtgtcgatgcgcgactcgctgcgcttcgtcggcacgcatcgcgcgaccttcgcatgccactacctcggcttctcgttctacgcgatgacgctgtactgcctgctgagctggacgcccgcgttctatatccgccgcttcgggatgacggccgtcgaagccggctacacgctcggcatcgtgctgctggtcgcgaacacggccggcgtgttctgcggcggctggctcaacgactggctgctgcggcgcggccgcagcgatgcgccgatgcgcgccggcgcgatcggcgccgcgtgcatggtgattcccgcgacgctgttcacgcaactcgactcgctgcccgcttcgctcgcgatgctcgtcgtcgcgatgttcttcgcgtcgttcccgatgccgacgtcgaccgccgcgatgcagacgctcgcgccgaaccagatgcgcgcgcagatctccgcgctgttcctgctcgtgtcgaacctgatcgcgctcgggatcggtacgaccgtcgtcgcgctgttcaccgatcgcgtgttcggcgcgccggcggcggtcggccattcgatgtcgatcgtcaacgtcgcggcggccacgctcgccgcgctgctgctcgccgccggctgccggcactatcgccgcagcctcgatcgcgagcgcggccatgcgtcggcagcggcaccgcaggcggccgaggcgggcaacgcaatcgccgcgcgctgaacgacgggcgcgctccgtcgccgaccatcatccattccactgattcaggcatcgctttttaatcgatttgatttatgcgatgcccgtccctattctcgatcgcatgacggcgcggtgtctgccgcgccgctttcctcgtaccccacggaatatcccatgcaagcgaaccgccaccaggtccggatcgacgcgctgatcgacgcggcgcaggacatccgctgtttcgggtttcgcgcatcgacggccagccgttcgacgcgtacgaacccggcgcccatatcgacgtcaccgcgccgtccggcatcacgcggcaatactcactgtgcggcaaccccgacgaacgcggcagctacctgttcgcggtgaagaaggaggcgcagtcgcgcggcggctcgcgttcgctgcacgacgatgtgcaggtcggcgccgagctgtcgatcggcacgccgcgcaacctgtttcgtctgacggacgacgcgagcgagcacgtgctgatcgcggccggcatcggcatcacgccgctgctgtcgatggcgtatgcgctgcaccggcgcggcgcgcgctaccggttgcattacttcgcgcgcagccgcgagcacgcggccttcgtcgacgaactgtcggccgagccgttcgcgtcgcacgtcacgttccactacggcgtcgagcccgacgcgctcgcggccgcgctgggccgctgcgtcgaatcggtcgacgcacacgcgcacgtctacacgtgcggcccggggccgttcatggaggcggtcgtcgcggcagccgcgacgcgcttgcccgaagactcgatccatctcgaacgtttcgcggcggaaccggtcgccgccgatgccgaccccacccctgccgatgggttcgaagtgcgtctgcaacgcagcgggcaatcggtacgcgtcacgcccgacacgtcgatcgtcgacgcgctcgcgcgcatcggcgtcgaagtcgacacgtcgtgcggcgaaggcgtgtgcggcacctgcatggtgcctgtcgtcgacggcgagcctgatcatcgcgaccactgcctcagcaaggccgagcgcgcgagcaacgcggtgatctgctgctgcgtgtcgcgcgcgcgctcggcggtgctggtactcgatctctgacgcatccggcacgcgccggccgccgtcacgcgttgtcgaaccctcgacaagctcggccagcagcgtgcgcatccacgcgttgccttcgtcttcatggaaatgctcgtgccagtgcatcgtcaccggcgcgggcggcagcgtgacgggcaggtcgtacaggcggaacgcgttgtcgcggttcaggatccgcgcgagccgcttcggcagcgtcgcgtagagatccgtgaccgacagcacgctcggcagcgcgacgaagtgcggcacctcgagcgcgatgttgcggcccacaccctgcgcgcgcaacgcgtcgtcgagcgcgtggtggctgtgctcgaccgatttcacgttgacgtgcgcggcgcgcacgaattgctcgaggctcagcgcgccgccgctcggcaacccgcgccggcggcccgtcatgcacacatacgtttcctcgaacagcacctggtggcgcgtacgcggcatcagttccggcaggttgccgatcgcgaaatcgagccggctcgcgcgcagcgcttcctcgatctcttccaccggcagcggctgcacactcagcgtcacgcgcggcgcgcgctcgcgcagcgcctggcagatcgccggcaggtacgccatctcgccggcatccgacaacgacagccggaacgtgcgcgtgctcgtggccggatcgaagcgctccgcgtagcgcagcgccacgcgcaccatgtcgagcgccttgccgacgatgcccgcgagttcgagcgcgaccggcgtcggctgcatgcccgagcgcgtgcgcacgaacagcggatcgtcgaacagcgtgcgcagccggccgagcgaatagctgacggccggctgcgacaacgcgagccgctcgccggccttcgtcaggctgcgttcctcgacgatcgcctggaatacgcgcaacaggttcagatcgagatgatcgaccgacgtcatcgtagcctccatcatttgccgtatttattgagtcgccaattttagatcaatttgacggatatgtagcaggagacgagactgggtactcgataccgtgcgctgcgcggcccgatttcgcgactcttccccacgacaacgatgagcgacattccctaccagacgatcgacacccgtgcgttgcacggcctcgcgcaacccgaccgcatcgcgccggcgatgtatcacgatcccgcgctgttcgaagccgagctcgagcgcatcttctaccgcacctggatctgggtcgcgcacgagagcgagctgccgaacccgggcgacttcatcacgacgacgatcggccgccagccggtgatcgtcgtgcgcgacaagaccggcgcaatcaacgtgctgcagaaccgctgccgccatcgcggcgcgaccgtctgcgaatcgcacaagggcaacgcaaagggcttcacgtgcccgtatcacagctggtcgtacgcgctcgacggcacgctgcgcgcgctgccgtacggcgacggctacgaaggcgtgtgcgagaaaggcgacctgccgctcgtgaagctgcgcgtcggcgtgtaccaggggctggtcttcgcgagcttcaacgacacgatcgagccgctcgaggatttcctcggcggcgcgaagccgtggatcgacctgttcatgaaacagggcgccggctacccgatcaaggcgaacggcgagcacaagttcaagttcaagggcaactggaagatccagctcgagaacacgaccgacctctatcacttcccggtcgtgcacaagtcgtggatgaagtcgatcgacgacgagacggccgccgcgatcacgagcttcatgacgagcgaggacgcgttctgccgcgggctcggcaacggccacagcctcgcggtgctgatgcccgagctgatcgatctcgacgaagacgacggcgcaccgctgcccgagcgcttcgcgccgctcgcggcgaagctcgccgagcgccactcgccggacgaagtgcgtcgcatcgtgcgctcgctgatgggtgtcggcttcaacctgaacctgttcccgaacctcgcgctgtcgatggcgttcttccgcgtgctgcggccgatctcggcgaacgagaccgagatccgccacgtcgcgctcgcgatggacggcggccccgacgaagcgaaccgcgagcggctgcgcattcacgagcacttccagggcccgttcggcttcgggagccccgacgacgcggaagcgtgggagcgcgtgcagcgcggcgcgcacgcgggccccgacgtgccgatcctcgtgaatcgcgggctgaaccgcgagacgaccgccgcgaacggcgaaaagaccgcccatgcgaccgacgaaaccggcatgcgcgaggcctaccagcaatggcgcaagatgatggagcagcaatgatggacgaccgcaacgccctcttttccgagcagaccttcgcccgcgcggtcgaattcgtgtggcgcgaagccgagatgctcgaccgccgcgactatcgcgcatggctcgacctgtgggatccggccggtcactacgtggtgccgatcgatcccgacacgaccgatttcgccgcgacgctgaactacgtgttcgacgaccaggacatgcgcgagaagcgcgtgcagcggatggtgtccggctactcggcgtcggccgccgacgcggcgcgcacggtgcgcaccgtgtcgcgcttcacgctggaaagcggcagcgccggcaccgtcgagctgaaatcggcgcaggtcgtcgtcgcgtacaagcgcggcgtcgcgacgctgttcgcggccgacgtcacgcacacgctgcacgtcgatgccgaaggcgagatgcggattgccgaaaaggtcgtgcgcctgatcgactcgaccgaagcgctcagcgcgatcggcttcctgctgtgagccgtggccggttcgccgctgcaagcgcaaaggtgagccggcaaccttcaccttccggacgaccatgcccacactcgaagtattcctgcccgccggccatgacgatgcacgcaaggccgaactgatcgcgcggctcagcggtgcgaccgtcggcgcgatcggtgcaccgctcgaatcggtgcgcgtgctgctcaccgaattgcccgccacgcatatcggccttggcgggcgcaccgccgccgacggcgcgccgccgtcgttgcccgtgatcgtcgcgatcctgatcgccggccgcaccgatgaacaaagcgcgcgctgatcgccgcgttgtccgacgcgggcgcgaacgtgctcgatgcaccgctgcaggccacgcgcgtgatcatcaaggacatcccgaacaccgacttcggcatcggcggccggaccgcgcgggcgctggggcgctgaccatgggccgggcgtcgctccatcatgcgccgcgggcgcgccgtgatgtccgtgatgtccgtgatgtccgtgatgtccgtgatgtccattgcggccttaacgcgatgcagcggctacgactacacgcccgcgagcggcagcgtcacgcggcagtcgagcccgccgccttcggccgggctcgcgccgatccggccgccgtgacgcgtcacgatgctcttgcacagcgacagtccgatcccgttgccgccggccttcgacgacgagaagccgtcgaacagccggccgtgcgcaccggccgcgatgcccgggccgttgtcgatcgcgcgcagctcggcgtgcccggccacgttcgcggtgccgagcgtcagcatgcgcggcacgcgatcgcaaccggcgaacgcctcgatcgcattgaacgcgagattcaggatcacctgcccgatcagcacgcgctcgcaacgaatcggcagcggcgcatcggcctgcacgatcgcgaccgtcacgccggcatccttcgcacgcagctcgatgaagtacgcgacgtccgcgaggatgtcgcgcaggtcggcgagcgcgacgaccggctcgcgcttcacgatgaattcgcgcacgctcttgatgatcagcgccgcgtgctcggcctggcggtccgcgctgcgcagccccagatcgcgtcgtcgatggcgccgcgcccgttcagccgctgcaccgcccttcgatgaaattgcgtacggccgcgagcggctggctcagctcgtgcgcgatcacgctcgccatctcgcccatcgcgttgtagcggcccgcgtgttcgagcatgcgcgcttcggcgcggcgcgcatcctcgatcgcgacttcgtcgctcacgtcgcgaaactgcacgagcagcccgtcgaggtcgccctcgatctcgacctgccggcacaggatgcgcagccagcacggcgagccgtcgcgccgcacgatccggtagcgctgtggcgccgacgggcacgcggacggcgcatcgtgcaattgcgcgacgagccggtcgcgatcggcctcggagcagtagtcgagcacctcgccgagcgcttcgtcgggcgcgagcccgagcacgcggcggcccgactcgctgatgaactgcacgccgccgcgcggcgacgaccgcgataccttcgtcgagatcctgcatgaactcacgcagccgcgcctcgtagcggcgcagctgccggcgcaccgcctcttccgcgctgatgtcgcggaactgcaccatcacgacgtcgcgccgcgcagcggcacgtaggtggcggtcgcctcggacagcatgtcgacgcccgtgcgcgaccggtagcaccattcgtacacctgcggcccgtcgacgagcgcgcgatcccacgcgctcacggcgatctcgcgctggtatttcggctcgggacgcgtcatgtccggcgccttcagcggcagcagttcctcgacggaaaaaccgagcgcgatgcacgcggcgcggttcgcccacacgatcgccttcgtctgcgcatcgtgcagcagcacgcaggtggtcagcgcgtcgagcagccggtggaaatcgtcgtcgtcagggaaactcatgatcggcttcggatgaaggcgcgcggcgtcgcgcggccggaaagccaacatagcaccggcgcgcgccgatcgcatctgaagatttctttaggccggcacggaacctcaccagtcgcgcggcccaacgcaccaattgctgcgtgttttcggcgtttctagactggtcgcatcgtcgtgttgccacccgagacagcacgcatgccgccccgcatccgaacccctatccgtccaggagaccaccatgccgcaagccgccctcgccatcgaacccgcgccgtcccccagcccgtggcaggcaccgcggccgcgccgttgtcgccgctcgacgccgtgatcgaaaccgtcgccgcgcgccgcgacgaattcgatcgcctgtcgcacgtgccgcgcgacgtgatcgcgctgttcaggcaggccggcatctatcgcgcgggcacgccgcgccgcttcggcggcgacgcgctcgcgccgactgccttcctcgacatgatcgaacggatcgcgaccgccgacggctcggccgcctgggtcgcgagcttcggctccgcgaacgtctatctcgccgcgctgccgctcgagacccaggccgagctgtacgcgagcggccccgaccaggtgttcgcgggcggcctgttcccggtgcagccggcgcaggccgcgccgggcggctggcgcgtgaacggcacgtggaaattcgcgagcggctgcaagggtgccgactggctcggcgtcggcatcgccgtgcccggcgcgcaggacgccgcgccgaacaagccgcgcacggccgtgttccgcgcggccgacgtcgagatcgtcgagaactggagcgtggtcggcatgcagggcaccggcagccacgacctgcgcgtcgacgaccgcttcgtgcccgaagcatggaccttcgtgcgcggcggcgagccgaccgtcgacgaaccgttgtaccgctacccgaccgtcgcgtatgcggcgcaggtgctggccgtcgtcaatctcggcctcgcgcgcgcggcgctcgacgtcgcgaaccgcatgtcgggcggccggcagacgacgaccggcgcgccgcgcctcgccgatcgcgcgtatttccgcatcgagctcgcgaaggccgaggcgcaactgcgctcggcacgcgcgttcttctacgacgcaaccgacacggtgtggcaatcgatcctcgcgggcaatcccgtgacgcccgaccaggtcagcctgctgcggctcgcggccacgcatgtcgcacgcgaaggcgcgagcgtcgtcgaacgcgcgtaccgcctcggcggcacggcggcgatctatcgcacgcatccgcttcagcggctgctgcgcgacgcgatggtcgtcacgcagcacgcgtttctcgcggaaggcaacttcgacggcgcgggcgcggtattcaccggcgtcacgccgtttcccggctacctgtaacccgcgcaacccgcgcccgggcggcgctgtttcccgaacgcgcatggcgccgatgccgaagcaccgctaccggccggcgcatgcgcccaaccgtttccctggagaacccgagatgtccgattcgaatccgctgccgctgcgtgtcctgttctgctgcggcgtgtcgcagaatttcttcgacctgccgcgcgagaagatcggcgaagtgtggcaggcgtacggcgcgatgctcgccgccgtcgaggcgatgcccggcgtgcgcgtgctcggcgtgatggacgacgaccgcctcgtggtcggccaggccgacggcgcgccgtggaccttctacatcatggccgacgtcgccgatttcgacacgacggtcgccgtgtgcaacctgtatcgcacgacgccggtcggcgaatacaacctgtggcgctatggcaagatcgaagcgcgggtcggccgcgcgctgaccgtgccgcccgccgcgaaacccgcgtcgtgaggcgcgcgatgaacgacctgtctcccggctcgtccccggcccgatcgacgcactcgcgcagctcgtggcggcgctcgacgccgagcgcgcggtgcgcgcgacgatgacgcgctacatggcgctgtgcgacgtgcccgaggatgccggcgacggcccgcggctcgccggcctgttcacacccgacgccgtgtgggaaggcatcggccctcaatacgcgcagaagttcggccgtctcgaaggcacggccgcgatcgtcgcgatgctgggccgctacctgccgcccgatccgcatttctcggcgaacctgcacttcctgacgtcggagtcgatcgagatcggcgccggcaacgcaagcgcgcgcggccgctggatcatgctgcaggcgtcgcgctacgcgaacggcacggccgagctgatcgccgcgcggctgaccgtcgatttcatgccggccggcgacggcgcgacctggctgatccagcactttcgcaccgaacgcgtgctcgacggcccgtggccgctcgccgccgcgccacggccctgatgctctccaccgcttccgcacgatatcgaccatgacaggcttcatcgacaccttcacgctcggcggcccgggccccacgatcgcgatcaaggacacgatcgacatcgcgggccatccgacccgcgcggcgagccgcgcgctcgccgatgcaccgccggccgcgcaacatgcggacgtcgtccgcctgctgctcgacgcgggctggcagatcgccggcaaggcgaacatgcacgagctcgcgttcggcatgaccggcatcaacgactacacgggcacgcccgtcaatccgcaggacgcgacgcgcatcccgggcggctcgtcgagcggttccgcttcgctcgtcgggctcggcgcggtcgatgcggcgctcggcaccgacaccggcggctcgattcgcgggccggccgcctgctgcggcgtggccgggctgaagccaacgttcggccgcgtgtcgcggcgcggcgtcgcgccggccgataccacgctcgattgcgtcgggccgttcgcacgcgatatccgcacgctggccgcggtgatggccgcgatcgcgccgggcttcgatcgtgcgcacgcggcggcctccgtggcgggctgcacgatcgcgcagatccgcgtcgaagccgatccggcgatcgccgccgcgctcgatgcagccgtgcgcgcgtcgggcctgcattcgcacgcgctcgtgctcgacgaaatgccggcgtcgttcgcggcggggctcaccgtgatcaacgcggaaacgtcgcgcgcgttcggccatctggtcgacaccggcaagctcggcgccgatctcgatgcgcggctgcgcaccgccgcgacgacaacacccgccgccctcgcggaagccgaagccgtacgcgcacgcttcaccgcgcaggtcgacgccgcgctcgaactcgcggacgtgctcgtgctgccgacgctgcccgcgttgccgatcacgctgcagcaggcgcgcgacggtgtatcggtgatcgcgatgtcgtcgctgatccggccgttcaacctgagcggccatccggcgctcagcctgccgctgccgctggccggttcggcgctgaaggcgggcctgcagatcgtcgggcgcaagggcgcggacgagcgggtctgcgcgatcgcggcacacttcgaagcggccctcgccgcatgaaccacgaagcgggcgcggcttcacccttcacgcgcccgcgaaccagggaatcacgcaccatgtcagaccgagtcgtcctcgttaccggcgccgcacgcgggctcggcgccgtcatcgccgaccgtttccatgcggccggctatcgcgtcgcgctggccgacatcgccgccgacgccattcatgcgcatgcgcgcgaactcgacccgggcggcgaacgcgcgatcgcgctgccgctcgacgtcacgtcgaaacgcgatttcgaagcggcgcgcgatgcgctcgtcgcgcgctggggcacgatcgacgtgctcgtgaacaacgcgggcgcatcgaaggtcgtgcccgcgatggagatcacggccgagcagttcgaccaggtgatcgacgtgaacctgcgcagcgtgctgttcggctgccaggtgttcggccagtatttcgcggaacggggcgcgggccgcatcgtcaacatcgcatcgctcgccggccagaacggcggctcggcgacgggcgcgcactacgcggccgcgaagggcggcacgctgacgctgacgaaggtgttcgcgcgcgatctcgccgcgcggggcgtgaccgtcaacgcgatctcgccgggcccgctcgacctgccgatcgtgcatgaaagcgtcgcaccggagaagctgcgccaggtgctcgcgagcctgccgggcggcaagctcgggtcggccggtttcgtggcggatgcggccgtgctgctcgcgtcgggcgacgcgcacttcgcgaacggcgcgtgctgggacatcaacggcgggttgtacatgcgctgagcggcgggctgcatcgcttgcgcgctgccgatcggtgccgcgcgcaggactcgtgtgagactcgtgcgagcaggcgaacgtcggcgtgcccgcagcccctatcgcgacgactccccgtcgtcgccccacacgaccatcacatcccgcacgagcgcggcgatcgacgtcgcgccgagcttctccttgatgctcgcgcgatgcacgtcgacggtcttcacgctgatcgacagatccgacgcgatctgcttgctgcccttgccgtccaccacgccgcgcagcacttccttctcgcgcgcggtcagcgcatcgagccgctggcgcagctcgcggtggcgctggctcaccgcgtgccgctgctgcgcgagccgcagtgcgcgctgcacgcgctcgagcatctgctgcgagttgtacggcttctcgacgaaatcgatcgcgccgttctgcagcgcgcgcacggacatcgggatatcgccgtgcccactgacgaagatcaccggcagcgtcgcgccccgcgcgttcagttcggcctgcacgtcgaagccgctcttctccggcatccgcacgtcgagcaccaggcacgcgggcaggttcacgtcgaagcgcgcgagaaaatccgcggcgttcgcgaatccctcggacgcgatgccgaccgattcgagcagccaggcgagcgatgtccgcatgccgccgtcgtcgtcgacgatgatacgatcggtgcgggtgacgtcatcgcgggggtctcgctgaatatcggtatgggtatcgcacgcgccgcatacggggccggttgccggcgcgtcgcgcacgtcgttcgctggggatgtgcggcacatcataacgagccgaaaacccgctgaaaaccccttcacgggccgcacgaacgcacattcccggtttttcgcgcgccgcgccgcgtacctaggtagaacctttagacgcgttggcgagaacgccatctccatcgtcaatcgtgcgaatggtcgccagccttttcgcgacgtacgcttgggtcatcgtcggcgatcaggcgctgcacccgcagcgccgcacgatcgccgctctcgtccaaccaggagcgcccatgtcttccacgaccgatatccagcgaccggcacgcgtcgagccgaccgacgcgcagaaggccttccggcaagcgatggcccacctcggcgcggccgtcaacgtgatcaccaccgccgggccgcacggccgctgcgggatcaccgcgagcgccgtgtgctccgtcaccgacacgccgccgacgctgctcgtgtgcctcaaccggtcgagcgcgatgcatgcgacgttcgaacgcaatcgccacgtctgcatcaacgtgctgccggccgaacacgaacagctcgcgcgacacttcgcggggctcaccgaactgccgatggaccggcgcttcgaactgcccgggtgggatcgcggcgagcaggacgtgcccgtgctgcgcgacgcgctcgcgagcctgcagggcacgatcgccgacatgaaggaagtcggctcgcattcggtgatgttcatcgaggcgacgtcgatccgcgtgcgcgacgacggcgacagcctgatctacttcggccgtgcgtttcatcgcgtatcgcgcacggcgtgcgtgcggtgaatcgcgcgtgactacgcggcggcccgcaacgcgcgctgcccggccgcgagcgcggcacccgcgaacagcgtcagcgccgaatacacgagcccgcgcgcgagccccgcgctatccgacacccagccgatcgcgaccggcccggcgatctgcccgaatgcaaagaccgtcgtgaacgcgctgatccctttcgcccagccgtcgggcggcaggttgtggcgcacgaaggccgtcgtcgacgcgacggccgacaggaacgtcgcgccgaacagcacgcccgacgcgaacgcggcaaccggatgcacgaacatcgccggcatcagcgtcgcgatgccgagcagcgcattgagcacggccagcgcctggccgccgcgcatccggtcgagcagccccgaccacagccgtgccgagacgacggtcgcgacgccgagcatcacgtagaacgcggcgaccaccgtgccgctcattcccgcgccgcgcagcagcgcgacgatgaacgtcatgtagccgatgtagccgacgccgaacaggccgtagccggccagcgcgagtgcgaatcgcacggggctcgcggtcgcggccggcaccgcaccgtcgcgcggcgcggcgggtgccgcgtgcacgcgctcgatgcggcgcgcggccgacacggccaccgccgagaacagcacgcatgcgaacgcgagcgcgaaccacgcgggctgccagccgtgtacaccctgcacgagcgtcgccggcacgagcagcgacgatgcgacgatgccccatccggtaccgccgtagtagaggccgagcagcaggcccgcgtcgcgcggcgacgccgacgcgagccgcgcggccagcacgccgccgctgatgaagatcagcgcgctgccgacgccggtcgcgagccgctgcgcgagcagcgcgtgcatgccggacgtgaacccgcacgcagccatcagcaatgcggtcagcacgcacccggccgcaagcagcgtacccgcgcgccagcgccgcgacagcaacggaaacacgagcgcaccgatcaggtagccggccgcgttcgccgtgttcagcgcgccggcctgcgcgaaggtccagccgagatcggccttcatcggcggcagcagcagcgcatacgaaaagcgcgcgaggccgagcgcgatcgcgctgccgagcgacaggccgatcgcgagccgccacgcggccatgcgatcggggtcacgttcggggtatggcgggtcgcgccggtgtccggctgcgacgggccggcaggctccggttgcggcgctgcgcgcatcgcgtgtctcctttgtcgttcgaagccgggagtcgacgcgacggaaccggcgtttctcacgcaccggtcccgactgtccgtcgaggcttccgattctgtcgaccgatcatacttgagccgtcacggccaggcacgcgccggcaggcagcacgcgcggaacgacggcagccgcttgccggcgctagcgctgcaatccggccacgaaggccgtcagcaatgcacgcccctccggccattgcgccaatcccgcttccgcattcaggtggccgcgcgggccgagccgcagcggcgtcgcgccacgttcgcttgcccatgcgatgccgcgcccggacgggtcgtacccgtcgtccgaactggcgatcgccagcaccggcaaaccgccgaaatcgccgcccggcacgttcgcgaacgcacgcgccgcggccggaaaacgcgggccgcccggatcgggcaccgcaacgagccatgcgccgcgcacgacgcgcgccgacgccgcgcgccagtgcgcgaacagcaggcaccccagcgaatggcagatcaacaccggcggtgccgcggcttgcgcgacggcttcatccagtgccgccatccagtcacgcaggtcgggggcatcccatgacgcgggtgccatgcggatggcgcccggaatcgcggcctcccagtggctctgccaatgatccggtcccgagttgccgatccccggcacgatcacgatcgtttggtccatctccatctccgtctccatgaacaggcgagcgctcagtctcgtccgccggaaaccggccgggaatggcaagtcatcggttattgagacaatatgccgatgaattaacggagcgggagaacggacatgtcgaatggagagctcgatcgcctggatctttcgatcctcgaggcactacaggaaaatgcgcggatgccgctgtccgaagtaggccggcgcatcgggctgtcgcagcctgcgacgtcggagcgcgtcaagcggctggaagaacgcggcatcatcgccggctacggcgcgcgcatcgacccggcggcgctggggttggggatgatggccatcatccggctgaagacgacgcacgaacacatcaagcccgcgctgcgcgcattcgccgagatgccgcacgtcatcgaggttcaccggatgaccggcgaggattgcttcttgctgaaggtactcgtgccgacaccgggacaactggaaaccatcatcgacgcgattgcccgtttcggcgcggtcacgacgtcgttggtgctccgctcgagccggtcaaaccgctcggcaaggcgctgctcggctgacacggcatcgggccgccgccacgcccgcgccgagcggcgatgcattcgtacgcatcgctgccgcgaacgacgtcggtcgccatgatcgaggccatcgaattcccgataaaaattcgccgaatgcaatacatcgattccgattcatttcattgaaaaatgacctggaatccgtcactccctttacccgcgctttaccgcacgcgcctcgtcaatccccgttgtttagcacgccgaggctaaaatccttgcaacgcattgcattcgtaaattcgtcagactaatatcaacgccactcatcctgtattcacgaaatgcctgatgaggagtggcaacttttagccgcgctttcatgttgaaacactcatgttcaccacaggagaattgacatgcaggacacccagcagatcgaattgcttgactggatgcaggaagacacgcaccccgaggccatcgacatgatggtcgaggacgccgtggtgccgttcggcaccgcgctctggccggtctgagcgggccacccgttctcgcggaagggccgcggcccttccgccgcttccggagacacgcatgctgaacctgcaccgcgcactcggcttccaccccgcgctgcgcgacaaactggcgcgcggcgaatcgggaaaactgctggtcggccacgacacccgcaaccgcgacatcgcgttgcgcgcatttgccgccctgcccgattcactcgatgccacaaccctctgcctcgaaagcaccccgcccgccgatatcaccgccgcactcgatgaagccgacctgttcgtgctgctgtacgactcgtcgtgcctgccgacaccgtcgccgagcgggccgccgttcctcgccgcgatccgcccggcgatcgtcgagcactggagcaagtcggtgctgttcaaggattacggcccgcatctcgacgaggcgttcgccgaatcgctcgacgacatcgcggcacgcaacggccggctgatcgacgcggccgcgcgcgcatcgcagatccgcttcatcgacgaagccgggaacacgctgacgggctcgctcgcgccggaccagaaatggacgagcgtggacggaatgggcaacctcgacgtcgtgcccggcgagatcgcgacgcacgtgaccgatctcaacggcacgatcgtcttcagcggcacgtttctcggcaccgtgccgttcgcgatcaagtacaaggtggccgagcggctcgcgacgctgcaggtcgagaacagcacgatcgtcggtttcgataccgacgacacgggcttccggcgcgatttctcggcctatctcgaccggcatccgaatcaccggcggatcgaggaattcggcatcggcacgaacctcggcattcgcgggctgtatggccgcaatgcggggttcgaggaacgtcatccgggcctgcacctcgggctcggcggcggcgaaaacggcagccaccatctcgacctgatcttcgcgcgcggcacgctcgcgctcgacgaccggatcgtgttcgacggcgcgttcgccgtctgattcgccagttgcgcgctcaggctccggcggcaggtgtgtcgccgagccacttgaacatcacgaggcaatcgacgaacccgagccgcgcgtgacgatacgcacgcggcaggcgcccgacgatttcaaatcccagcttctgccacagcgcgaccgccacctcgttcgtcgagacgaccgagttgaactgcatcgcgaggaaaccgcgctcgcgcgcaacctgctgcgagtgctcgcacatcaggcgcgcgacgccacggccgcgcgctgcctcgctcaccatgtagccgcaattgcacacgtgattgccggggccggccgcattcgccttcaggtagtacgagcccagtaccacgccgtcctcctcggcgatccacgtgcagagcggcgcatcgagccataacgcgcgcgctgcttcgggtgtcgcatcggaatcgaatgcataggtttcccgagcagcgacgatggcgcgataggtcggccagaagcgcgggaaatcgtcgtcggtcatcgggcgaatcgtgatcatgcgggttctctcttgattggaatgccggcaggacagccggcgatcgtggcgtgattcaggaacggccgccgtcccgttgcgccgcgctgcgatacgcgcccggcggcacgccgtaccagcgcttgaacgcctgcgagaaactcgacaggtcgctgaagccgagccgctcggccacttccgcaagcgacaggcgtgcgtcgccgagcagcgtctcggccatcgcgccgcgcgcctgcgcgagcagcgcccggaacgtcgtgccctcctcctgcagccggcgcttgagcgtacgcgggctcgtgttcagcagccgcgccatgtcctcgagcgagaacggcgcggggccgggcgtcgcgcccaggtactggcgcaccatctccgacgtgcccacgcgcgcgcgccgcgcttcgagcagctggccgcacatctgctcgcacatcgacaccgtcagcggattcgcgtgcggcagcggccggtcgagcaacgcgcggtcgaacgcgaggctgttcgcgcgcgccgaaaaaccggctcgacgccggcgatgcgcggcaccggcacggacggcgcgcgcgtcgcctgcaccgtgaagcgcgacagttcgaatgcgtcgccgccgatttcccgcagcaatacggccgccgccgtcatgtcgcgctcgacgaggaaccggctcagcgcgccatcgagttccggcgcgccgaaattgagcacgcacgtgctgccctcttcacgatacgtgatcacggtgaacgcataggtgagcggcaggaagcgcatcgccagcgcgagtgcgtcgcgcgcggtcgcgctcgcgatcagcccgtagccccacacgccgtacgcggagaagtggtagcgcaggccgacctcgaacccgaggcccggcgcccgcccgagcgcgcgcagcaggttgccggtcagccgcagttcctgcgcggccgtcacctcgaccttcggatcgtcgagctgagcgttggcgagccccgtgccggccagcagcgtcgcgtgcggcacgccgcgttcgtcgccgaaatcgaccagcagccgggcgctggccggactccgggtgaagtcccagaagctcatgcggagaaaccctcgaagcgccgatttggcccaaatactaaaacaattgtcccgaagcagcattggtgttttcccatgcggccagcaccatcggcgtcatccagtcgtcgcccgaacgacgccaacgcccccggaggagacaccatgcgacgcagtcgcccgaccgatcccgcagcccgcttcgcacgccggcgcgccgtgcctgcacgaacccttgcccctgcccggccaagcgccggccgcccgtgcgcgctgccgcgccccgcctgatccatcgaccatcggaggatgaacccatgagcaggactttcgactacatcgtcgtcggcggcgggtcgggcggctgcgtcgtcgccgggcggctgaccgaagacccggccgtgaccgtctgcgtgctcgaggccggcggccgcggcgacggcacgctcgtcaacgtgccgaccggcgcggtcgcgatgatgccgacccgcgtgaacaactgggccttcgacacggtgccgcagcgcggcctcggcgggcgcatcggctaccagccgcgcggcaaggcgctgggcggttcgtcggccatcaacgcgatggtctatatccgcggccatcgcatcgactacgacggctgggccgcactcggcaacgaaggctgggcctacgacgacgtgctgccgtacttccgcctgagcgagcacaacgagcgcttcgacgatgcgtggcacggccgcgacggcccgctgtgggtaagcgacctgcgcaccggcaacccgttccatgcgcgctacctggaagcggcgcggcaggccggcctgccgctcaccgacgatttcaacggcgcgcagcaggaaggcatcggcatctaccaggtcacgcagaagcacggcgaacggtggagcgcggcgcgcgcctacctcttgccgcacatcggccgccgcgacaacctgacggtcgagacccacgcgcaggtgctgcgcatcctgttcgacggcacgcgcgcgaccggcgtcgaagtccggcagcacggcgaggtccgcacactgcgcgcccggcgtgaagtcgtgctcgcggccggtgcgctgcaaacgccgcaactgctgatgctgtcgggcgtcggcccgggcagcgagctccggcaacggggcatcgcggtgcacgccgacctgcccggcgtcggccgcaacctgcaggatcatccggatttcatcttcggctaccgcacgcgcagcgtcgacacgatgggcgtatccgcgcgcggcggcgtgcgcatgctgcgcgagctcgcgcgctttcgccgcgagcggcgcggcatgctgacgtcgaatttcgcggaaggcggcggtttcctgaagacccgcgcggacctcgacgcaccggacatccagctgcacttcgtcgtcgcgctcgtcgacgatcacgcgcgcaagctgcacgccggccacgggctgtcgtgccacgtgtgcctgctgcggccgcgcagccgcggctcggtcacgctcgacagcgccgatccgctcgcggcaccgcgcatcgaccccgcgttcttcgacgatccgcgcgacctcgacgacatggtcgctggcttccggctcacacggcggctgatggaagcgccggcgctcgccagctggaccacgggcgacctgttcaccacgaacgtcgacaccgacgatgaaatccgcgacgtgctgcggcggcgtaccgacaccgtgtaccacccggtcggcacgtgccggatggggcacgacgcgctcgccgtcgtcgatccgcagcgcgcgtgcgcggcctgcagggctgcgcatcgtcgatgcgtcggtcatgccgacgctcgtcggcggcaacaccaacgcaccgacgatcatgatcgccgagaaggccgtcgacctgatccgcggcgtgtgccgcacgcccgcgcggccgcagcgcgaaaccgtcaggacagcgacggattccgctcccgcttcgcgcgccgcgcacgaagccgtccagcctgaggagacccgccatgtcgtcgcgtgacgctgcccacctgaccgaatccgccgcaccgctcgcggcgatcatcatcggcgccggcttcgccggcatcggcatggccattgcgctgcaacgtgccggcatccacgatttcgcgatcgtcgaacgctcgcacgacgtcggcggtgtgtggcgcgacaacagctacccgggcgccgcgtgcgacgtgccctcgcacctgtactcgttttcgttcgagcccaacccggcctggtcgcgcgtgttcgcaccgcagcccgaaatccatgcgtacctccagcattgcgcgcgcaagtacggcctcgcgcgctacctgcgcttcggcgccgacgtcgcgcatgcgcgttacgacgaagccgccgcgctgtggcgcgtcacgctcgccgacggcacgacgctcagcgccgccgtgctcgtcagcggcaccgggcagctgagtcgccccgcgatgcccgacctgcccggcatcgacacgttccgcggccgcgcattccactccgcgcactgggatcacgactatgcgctcgccggcaagcgcgtggcggtggtcggcaccggtgcgtcggcgatccagttcgtccccgcgatcgccggcgacgtgcagcgcctgaccgtattccagcgttcgccggcctacgtgatgccgcgccccgaccgcgcgtaccgcccgtgggagaaggcgctgttccgcacgcttccgtgggcgatgaagctgcatcgcgcatcgatctacctgcgctacgaatcgcgcgcgatcgcgttcacgcgcctgcaccggttgatgaaggtcgcggtcggccggccgttccgcaagctgctcgcgcgcgacgtgccggacgccgcgttgcgcgcacggctcacgcccgactacccgatcggctgcaagcgcatcctgctgtcgagcgactacctggccgcgatgagccgcgacaacgtcgaactcgtcacgcagcggatccggcgcgtgacggagcgcggcatcgagactgtcgacggtgtgcatcatccggtcgatgccatcgtctacggcacggggttcgcggcgaccgagttcctgtcgccgatgcgcatcacgggccgcgacgggctcgacctgaacgacgcatggcggcgcggcgcgcaggcgtatctcgggcttaccgtgcccggttttccgaacttcttcatgctgtacggcccgaacaccaatctcggccacaactcgatcgtctacatgctcgaaagccagatcgcgcacgtgatgcgctgcctgcacgcgatgcggcgcaacggcgcgcgcgagatcgacgtcgacgcgcgccgctaccggcgcttcaacgcgcatgtgcagcaacggctcgaaggatcggtgtggaacagttgcaagagctggtatgtcgatgcatcgggacacaacagcacgaactggccgggcttcacgctgacctaccggtggatcacccgtttcaccgggatgtccgcctaccgtttcactcatccggtgcccgaatcggttgccccgacgcgcgacgtcgtggtcgcgccgcccgccggcccgctggaggcactcacggccgcctcgctgcgcggtttcctgcgcgtggcgttccggccgctgatcgggccgccgttcggcgcacgcgcgcaacgccgcgtcgtcgcgctgctgtcgccgctgatgcccggcacgggtggcacgctgcgctaccgtacgcacgcgcaccgcgtgccggtcgaagtggttgcgccgaaacgcggcgacacgggcggcgcgatcctctatctgcacggcggcgcattctgcctcggcgggccgcatacgcatcgcggcgtgacgacgcggctcgcgaacgacgccggcctgccggtgtgggtgcccgattaccggctggcccccgagcatccgggcccggccgcgctcgacgatgcgctggccgtctacgacgcgatgcgcgcgcagggtcacgctccgcaccggatcgcgatcgcgggcgattcggccggcggtgcgctggcgctggcactggccatcgcgctgcgcgagcgcggcgagccggccgccgccgcgttgctgctgatctcgcccgtgaccgatcccgcgctcggcggcgcgacgctggcctcgcgccgccacgacgatccgatgatccgccgcggctggctcgagcaagggctgcgctggtatcacggcgccggatcggcggcggcccgcggcccgctcgataccgacctgcgcggcctgccgccgatgctcgtccaggccggcgaccaggaagtgctgctgtcggacgcgcagcggctggccagtcacgcgcaggcctgcggcgtgccgtgccggctggagattcatgcggcgcgctggcatgtgtttcatctgcagtcgttttacctgcgctcggcgcgggacgcgttgcgcacgctggcggagtttgcgtcggcacgcgttgccgcgacggcatgacgatgcaacggtaacgcacgaggattttccggcgggcgcgccgcacgacgcgcccgccgtcggactgttcgcgcacttgcttcacgtcccgctcatggcgcgtgccctcggcacgcgccatcgacaccggccattcggccgaatcgccacgccaggtaccggatgaaagaatgatcttcgtccgggaagccggtttcgctgcctgcgctgcaactgccacgcatgcggcgtcgtgtgtcgtcccgactcgccaatgcgcgcacgcccctgcgcacaccacccggcaactcgcacgaccgcctcctttctcatccacccttttgtagcttataagttacaatgctctccaagttcgaacttcttcgctaccagcgcgacgatggtcgcgagcccttcaccgaatggttgaacgccgtgcgcgacaagcttgcacaggcccggattcgcgaacgcctgcgccgcgtgcaaacgggcaacttcggcgattgcgagcctgtcggcgaaggcgtgatcgaactgcgcgtccacgtcggcgccggctatcgcgtgtatttcgggcggtacggcggcgcactggtgctgctgctgtcgggcggcgacaaagcagccaacccgacgacatcaggcgcgccaaggaacacgggtcgaactggaaacggaggcaaacatgaccaagctcaaaggtgcggtatcgcaccacgacgcggaagtcgccgaactcggcgccgaccgcgaactcgcagtggcctatctgcgcgtcgcgatggagtcgctcgacgatcccgacaaccgcgcggccggcctgctcgcgctgcgcaccgtcgcggaagcgtacggcgggctcggcgcggtcgcggccgaagccggcatcagccgcgaatcgctgtatcgcacgctgtccccaacggcaaccccacgctgaaaacgctgctcgcggtgctcaagaccgtcggcttgcgcctgtccgtcgtccccgcgcagccggcgcacgcgtaagcggcgcacggcccgctcacggcctgaccatccataccagcagcatctcggccggcgcggccgtcgtccccgccggcggatgcccgatcgtcggctcgaccgccagcgccttcgcaatcgacgccgcatcgtcgatcgtcgtcgagcgcacgatcgtcatcagccgcgccggccgatgcagcgtctcgcgatacagcgcgccgtaccacagcggccgcatgccgagcgcgtcctgcaacacgtacggataacgccacagccgcagcacgaggcggctttccggctggcccggatcgacgcgcacgaacacgcggcgcgtgctttcgccgtgcgtgtaacgcggcagcaccggcagcgcctcggccggcgcctgcggcagcagccagcgcagcgcggtggcgggcgaccacggcgtcgcgcgctgccagccggcctgcgcgagatgccggtcgagcgtgtccgacgtcgcgctccattgcagcggcagatattcctcgcggtcgccgccgatctcggtacgccgtaccggcacgcgctgccacccgccgcgcagccactggtcgacggtcatcgcgaccacgtcgccgacatgcgggcgcgccgcccggtcgagctgccattgcgcgggaaccgtccatacgccggccgtcgcgagcaccacggtcaccgcgacgagcgcgccctcggctgcacatgctcgcgcacgcgccagtacgcgtaggcgccggccagcaacgcgaaccaggccagcccgaggctccagccgcccagcaggcccgacagccacgtgtctccgacatacagccgcgcgaagccgccgagcacgatccacagcaccaccgcggtcacgaccgggatccgccacggcgcgggccgatcacgcgtcagcacccagccgaggccactgctcgcgagaatcgcgaacgcggcttcggcatcgggcagcggtacgtgcagcgcgccgggcggcaggctcgcgggcgtcgcgccgggtacgcccgcgccgaacgccggcacgagcaagacggcgacgccgacggtcgcgagccaccacgcggcggtcagccagcagcgatggatcatcagccagacgagaaacgcggccgcgacgatcagccccgtatcgtgcccgtgcaacacggcaagcgcgcgcatcacggcgtccaccggcggcgtgcgcaggttctgcaggaacgcgtacagcgcgatgtcagcgtgcgtcaacggatcgttcgcgacgacatcctgcacgaggcccgcgaacagccacacgcagccgacgaacagcagcgcgagcgcgggcaccgcgcccggcaggccgcgcacgtatgcgatcgcgtcgtgcagccgcgcgccgaaccgcggccagcggtgcgcgcatgcgtgcccccttcggcgagcgcacgacgcaacagcggccaaccgcgccgcagcgcgacgcgcacgccgatccacacgagcgcgaccagcgccgcgacgaccagcaggatcacggcgacccgcacgctgatcgccgcggccagcgcggccgacgcgccgaacacgatgcccggcgcgacgtgcacgggcgcccagatgagtgccgagacgacgttgaccggatagaacgaccggcgcggcagcgtcgcgcaaccgacgacgaccggcacgaccgcgcgcaccggcgcaagaaaacgtgcgagcacgatgctcttcacgccatggcgcagcacgaactcctcgccgcgcccgtaggcgttcgcataaccgaagcgcgcccatgcgttgcggatcatcccgcggtagtgccgcccgagctcgtagctgatgccgtcgccgatcacggcgccgaccgccgcgacgccgatcgtcgtccagccgtcgagcgcgcccgcgccgatcagcgcaccggccgcgaacatcacggcgccggccggcacgaccgtgccgatcagcgcgatcgcctcggcgcacgcggtcacgaacacgaccgcgagcacgagcagcggatgcgcgccgatcgcgccgatccacgcgtggatcgtgtcgctcattgcacgctccatggcgaagcgacccggcgtgagaacaccgggccggcgatggcatggggagcgttcatcgggcggtgcgcgcggtcgcgccggcgtggcggatcaatcgaactcgtgctgccgcgcgtcggcctcgagcggcgcgtcgtggtagccgaccgtcgcgatctcctgcagatagcgcgcgagaaacgcgccgatcgatccggcggcctcgtattgatgcacgtggcgaaattcatgggtcagcaggcggcgcgtgtcctgcccgcgcagcacgtacaccgcatgaccgagcgtgagcccgatcgtccccggcgacaacagccccgtgtcgcgggcgatcgcggcgagcgtcggcgtctccggaaacggcatgcgctcgacgatcaccacgcggatccgctccggctgggcgacacccaccttgcgcgcgtcgtcggcctgcgccggcgtcagcggcgcaccctgcgcgatccgcgcgccgcctccgcttcggcccacgcgacggcggcgggcagtgcggacggcaggatatcggcaagatcgatcatcacggggctcctcgttagtgtcgtggcatcgggcaccagtttagtcccgaatccggacggttcgcggggcggctggcgacccgccgcgccgcccggttcccgccgccgcgaccacccgggaataccctgattcgcgcccgccccgccgcgtatgttttctcgggaattatttcgtttcagtgcacattcgccgaaaacctgtctcgaaaatttaccggatgtgtatcgttttcggattcggcggaatatattggtcagaagaacggccgcggcgaccaccggacagcagggcgcggcgtcatcccgaagaggatcgctagatgatcagggtaattctggctgacgatcacgcagtcatgcgggacggactgcgtcacatcctggagacggccggcggtttcgaaatcgtcggcgaggcaagcgacggctcggccacgctcgcgctggtcgagcgcggtaccgccgacgtgctgctgctcgacctgtcgatgcccgcgccgaccggcatcgagctgatccggctggtgaagcaccacgcgccgtcgctgcgcatgctcgtgctgacgatgcacgcggaggcgcaatacgcggcgcgcgcgttcaaggccggcgcaaccggctacctgacgaaggacagcgcgaccgccgagctcgtggaggcggtcggcaaggtcgcggcgggcggcgtctacgtgagcccgtcggcggccgaaagcctcgcgctcacgctgcgcgcgccggccgcggcactgccgcacgaacggctgtccgcgcgcgagctcgacgtaatgcgccgcatcgtcgccggccagaccgtcacgcagatcgcgaccgaactcgcgctgagcgcgaagacggtcagcacgtacaagacacggatcctcgagaagatggaactgccgcacgaagccgcgctagtccgctacgcggtgcgccacgacctcgaccccggcggcgacgcatgacggccgccttccaccttccgccctcgcccccggacgacgacacctccgacgcgtcgcgcctgttcatgtcgtcgctgccgccgggccggcgcgaacggcggctcgcgctcgcgaccgtgctcgtgtccgcggtgatcttcgccgcgcttgcgcccttcgcgggccggccgcttgcgccgggctgggcgttcatccccgtgtaccagtcggcgatcgtcgtcaacgacatggtgacggccggcctgctgctcggccagtacgcgatccttcgcgagaagccgctgctcgtgctcgcgggcggctacctgttcacgggcttcatggccggcacccacatgctgacctttcccgggctgttcgcgccgaccggcctgctcggcgccggcgaccagaccaccgcctggctctacctgttctggcacggcggctttccgctggcggtcgccgcgtacgcgctgctgcgcgcggcatcgcctgccgcgggcccgatcccggccccgcaacgccgcgcggcgattcccgtggtgctgtgcatcgcggccgcgctcggtgcgacggccgcgctcgcgctgctcgcgacggccggccacgacctgctgccgcgcatcatgaacggcaaccggatggccgcgacgatgacgaacgcgatcacgatcgtctggggctgaacctggtggcgctgatgctgatgtggcagcggcggcggcggcattccgtgctcgacctgtgggtgatgacggtgctcgtcgcgtggctgttcgacatcgcgctgtcggcgatgctgaatcacgggcgctacgatctcggcttctacgcggggcgcgcgtacggtctggtcgcgtccggcgtcgtgctgttcgcgatgctgttcgaaaacggccggctgcatgcgcagacggtgcgtgcgctggccggcgcgcgctaccagcatctgctcgtcgtgcagaagagcgcgcagctgaacgacgcgaacgaacggctcgaacagcgcgttgccgcacgcaccgcgcaactgagcgcgtcgaaccgcgacctgcggcgcgaagtcgaggaacgcgtacgcgccgagcgagcgctgcaggcgtcgcgcgaggagctgcgcgagatcgccgcgatcagcgcgagcgcacgcgaagccgagcagcgccgcatcgcgcgcgagctgcacgacgaactcgcgcagacactcgcgacgctgaagaacgatctggaatggctgatcgatcgcgtgccgcaggacgacgcactgctggcgcgcaagatcgcggcgatgcacacgctggcgcgcggcgcggtggccgcgacacgccgcatcgcgtccgacctgcgcccgctgatgctcgacgatctcggcttcgccgccgcgatgcaatggctcgtggaggatttccggcaccgccacggcatcgactgtgcgctgcatgtcgacccgcccgaactgcaactcgacgagccttacgcgacggcggtattccgcatcgcccaggaagcgctcgcgaacgtcgcacggcacgcggccgcgtcgcatgcgaacgtcgcgctcgtgcaggcgaaccaggcgatcgagctgacgattcgcgacgacggcgcgggattcgatcccggcgtgccgcgcaagtcgggatcgttcgggctggtcgggttacgcgagcgtgcgtatctcgttggcggcacgctgcggatcgcgacgacgctcggcgaggggacgacgatcgaggtggagattccgctgtcgcctgcgcctgctgcggtcgcgcatggcgggaatggggttcgaggatcgatcgctgatcgaggcggcaatatcggcaaatgccggccgccgcgtcgatcatgcgtcagtggtagtcgtcttcccgttgatgtcgcacggccagaatcgtgacttgctcggccgcttcaatctcgaacaacaggacatagcccgacgtgccgaaagacacgatcagctcgcgcagaaacggattcccgtcgtcgatcttgcggcatgtgaacggaaacattcggagcatggcgataccttgttcgatcgcgtccgcagcccgctgccgctgccgctgcatcgctatcacgttcgagcaggtatcgatgcatctgcaccagatccccacgggccgcacgtgtatatcggacccgatagatcaatccgccgccttcgctgttctcgcagcgttcagcatgccctcgagttcggcctgcacgtcggcggcatcgacgtattcgccggtacggcgcgcctcgtcgcgcgatgcaaggccacggttgacaaactcgcgccgcaggcgacgacgcgcgataccatcgcgaagcgccgactccatgaacgcagacaacgtctcgttttcctcaaggaccgactctgccgcctcccgcaattgcggatcgacacgcagcgccggtatggtcgcggttttcatcgcacacccatggatcacatatgtaatccatggtagcaaaccctctttacgcgtgcagtcggccattcggcctgaccaacgtgtccggaaccacaatccggccgcgccgagccgcgtgcctcacgcccgcatcgccaccatccccgctccgagcgggtccacgcgaccagcgcgccgattccgagcagcgcgagacacacgatcggcacgatcatcggcccgaacgcggtgcccgtcaccttgccggcaaacggcattaggttctggctgaagaagccgccgaggttgccgatcgagttgatcgccgcgacgctcgccgccgcccgcgcgccggtgaagtagcgcggcggcatcgaccagaagcacggatacagcagcggaatgcatgcgccgccgagcaccagcgcgatgaagcgcagcggcgtcgacggcagcacgaggctcagcaggaagccgagcgcgccaagcgccgcgacgatcgcgatcgtgcgcaggatgctcttcgcgcggcgcagtttcccggcagccacaccagcagcagcaccgcgagcgcccacggcagcatgctcaggaagccgttcgtcgtgctcgacacgccgaacgatttcacgagcgtcggcagccagtacgtcacgccgtacagcgacgtcgacatcagcatgtaggtcgccgcgaacagcatcacgcgcgggtcgagcagcgctttccacggctggccgtgctcggcctgcgcgggtttctcgcgttcgagcgcggcctcgacgatctgcttctcgcggtcgtccaggaaacgggcgtcgcgcaccgacgcgggcagcacgcggaacacgacgatcgcgacgatcaccgccgggatgcccgtcgccacgaacacccactgccagcccgcgagcccccacacgccgttcaggctcagcaacacgccgccgaccagcgagccgagcatgttcgcgagcgcgctgccgagcgtgaagatgccgagcaccttcgcgcgatagctctggggaaaccacaacgtcaggtagtagatcacgcccggatagaagccggcctcggcgatgccgagcacgaagcgcagcgcgcagaaagcgggcatcgacgtcgtgaagcccatcagcaccgtgatcagcccccacgtcagcatgatccgcgcgagccacacgcgcgcgccgtagcgatgcagcgcgagcgtgctcggcacctcgaacagcaggtagccgatgaagaacagcgacgacgcgagcccgaacgcggcttccgtcatcccgaggttgtgcaccatctgcagtttcgcgaagccgacgttctgccggtcgatgaacgcgatcaggaacatcacgacgaggatgggcagcaggcgccgcgccatcttcgacatgatgcgctgttcttcggcggacgcggggtccagggtgtcggtagcattcacttcaggctccttgcgtgaatcggttgcacagcggttgcatgtcgtttgaatcggcgccgcgcgcgacgatcgcgcgggtgcggggcatgtcggggaaaggaagcggcggcatcagcgcgaccggtagtcgtcgagcatcggcgcgaacatctcgtgccacgcacgcggcttcgccttgatcgtgccggccaggtacaggaattcgacgtagtccatcagctggttcggcagtaccgagaaacgcgtgtcgggcgcggcgagcatccgcatcacgtcgtcgtgcgacacgccgacgcccgacgacgccgcatacagcgcggccgccgcgcgcgggtcctgcgcgatcaggcggttcgcttcgtcgagcgcgccgagaaacgcgacggccagcgcggggtccgtatcgacgagccgcttcggcgcgaatacgacgtcgagcgtcagcgggccgagcacgtcgaccgaattcacgacgcggtgaatgcccagctgccgcagctcgagcgtcgagaacggcggcgacgtgaagtgcgcggtcacgccgttctcgcgccggatcagcgcctgcatcgcctgcggatgcgggaggttcacggtgatcgaatcgagctgcgcgaaatgcttcgcgccgagctgccggctcgcgaccatctgcagcacgaccgccgacagcgacgtgcggatgccgggcaccgcgatccggtcggacggcgtgaagtcgcgcagcgacacgaggcccgcgcggttcgcgttcagcgacagcgacgtggtggacagcccgctgatgccgatcacctcgacgttcggaatgccgcgcgcccgtgcccacagctcgatgaaccccggagcgccggcgcccgcgaaatcgagcgtgccggccatcatcgcgtcgttgacggaattgccgccgtcgagcagcacccagtcgaccgcgacgtcgcgcacgccgtggcgcgccgcgtgccgctcgaacagccgctgcttctccatcacgagcagcggcaggtacagcaccccgaagcctttcgagatccggacggtgcgcggcttcgcgcgcacgagcggcggcgcggccagcatgccgatgccggcggcgatcaatgcgcggcggcgcggcgacgtcgtcatgcgcaggccgccgtgcgacggacggcaaacggccacgcgacagcccgcgtcgcgctgcgccgcgcattcgtcgtgcccgtgacatgctgcatgttgccgtctccttgaatatttctggtattaatgccgtccttgcgtgctgcatccggctcgacacaggttatcgaccgagtctgagaaaatgctgacatcccggccccgggaaaacccctaacccacccatctgcgaaaccgcaccatgcgcattctcgtcgtggaggacgatgccgaaatcggcgcggcgatccgcagccgcctggcgcggctcggccatgccgtcgatctcgagaccgacggcgcgaccgcgaacgggctgctgcgcgtcgagcgcttcgacctcgtcgtgctcgacgcgaacctgcccggcatggacggcttcaccgtgctgcgacacctgcgcacgtcgggcagcacgacacccgtgctgctcgtcaccgcacgctcggcgatcgacgaccgcgtgagcggcctcggcctcggcgccgacgactacctggtgaagccgttcgactaccgcgagctcgacgcgcgcgtgcaggcgctcctgcgccgcaacagcggccacgcgaacgacgtgctgacgctcggcggcctcgtgatcgaccgcagcagccgcctggcggaactcgacggccagccgctgtcgctgtcgcgccaggaattcgcgctgctcgaaatcctcgcgagccgcccgcaacgcatcttctcgaaggacgaactgctgaaccagttgttcagcttcggcaacgagccgaccgcgaatgcggtcgagcagtacgtgacacgcgtgcgcaggaagctgcagggcagctcggtcgagatccgtaccgcgcgcgggatggggtatcagattgcggcgcactgactggttcccgaagacgctgttcgggcgcacgctgctgttcatcgcgctcgtggttgcgtccggcgcgctcgcgctcgcggcgatcgcgcgctactacgcgggcgtcgcggccgaacgcgcgtacgaccagttgcttgccggcgcgtcgatccaggtcgcggaaaacctctacgtgcagggcggcgtgctcgcgctgaatccgccggtggccgcgctgtcgacgctgtcgcgctacgacctcgtctactacaaggtcgtcgattcgcgcggcatcgtcgtggccggctacaacgatctcgcgagccccgtgacgctcgccgccgcgaaacagggcccggcgttcgcgaacggcctgtaccaggggcaccggatccgcaccgcgaccatcgcgcgttacatgcccgaggaaagcacgcctggctgggcgctcgtgaccgtcgcgcaaaccaccaacgcgcgccagcagctcacgaacgacatgagcatcaaggtatggacgctgatcctgctgatgagcgtgctcgcgatcggcgcgagcggcctcgcgatccggcgcggcctgcgcccgctcgcgcagatcggcacgatcatcgccgcgcgcgacccggccgacctgcggccggtggccgtcgacacgccgagcgagatcgacgcgatcatcgggtcgatcaacggattgatacaccgcctggccgagcggatcaacgcgatgcagcgcttcatcgccgacgcggcgcaccagatgcgcacgccgctcgcgcgactcgacgcgcagatcgagctgctcgacggcgaatccgatcccgcgcgccatgcggcacgcctcgacgcgctacgcgcgacctcttcggacgtcggccggctcaccggccagttgctcaatcacgcgatggtgatccatcgcaccgaagccgtaccgctgcagccggtcgacctcgtcgcgctcgcgaaggacgtgctcggccgcgcgattccgctcgcgggcgagcgcgatgtcgccgtcgcattcgcgagcgacgcaccgctcgcctggatcgacggcgacgcgatcagcctgcaggaagcgttgtcgaacgtgctgcacaatgcgctgctgcacgggcatgcggacgacatcgtcgtgtcggtcgcgacgaagggcaacgcaggcgataccgtgacgctgaccgtcaccgacaacggccgcggcattccacgcgagcattgggatgccgcgctgcagccgttcgtgcggatcgcaccggacggcagcgagcggcgcacgggtcgggcctcgggctcgcgatcgtgcaggaagtgatgaaggcgcacggcgggcgcatcgggtttgcgtttcccgatgcgggcgggttcgcggtggtgctgacgtttccgcgtgcggcggggatcggcgccgcgcaggcatgaagggacggaccggtgccggatcgggcgcggcaggcgctcagtcgtcgtcgttgtcgtcgaagcggttccgctccgcatgccgcgcgaccaactggtccagctcgtcataccgacgatcggagaacagccggcacaatgtgtcgacttccgcgcgcgtgtcgacgtcgatcgtgtcgacatgccgttccagcttgcctttgccgatcccgaacagccccttcttcatccgcatcgagacggcattcaactggaagccgtccgcatgcgcgtcgctcagcgcggtcacccacaattcgcgctgatcgtcgacgtgctgcagcacgagcgcgggcaacggtccttcctgcgcgtcgtcccattcggcatgctgcgccgcccacgggaacgtgtcgaaggcacgcgtgaacgacgcgtagtccgtcacgccctgagggtcgagttgagtgtagtcgtagccggttttctgaatggcgtaggtcaacatggcgcggcgctcccggtggcggtaatggcgactgcgcgtaatctacctgacaattcggtgtacctcgcagtttttcgcgaggccgggtccgggcaccgccatcggccccgcccgctatgccgccaccgcctcgccaccgagatacgcatcgcgcacgcgctcgtcgtcgagcagcgccttggcctgcccttcgagcacgacgcgccccgtttgcaggacatacccgtaatgcgcgatctccagtgcgaggctcgcgttctgctcgaccatgaacacggtcacgccctgcttgttgatcgcgtcgatcagttcgagcaccttgtcgacatagagcggtgacagccccatcgtcggctcgtccatgcagatcagcttcggccgcgccatcaatgcccgcgccatcgccagcatctgctgctcgccgcccgacagcgtgcccgcgcgctgcgtcagccgctcgcgcacccggggaaacaggtcgagcacgcgttcataatcctcggccaccgccgcgcggtcgccgcgcgtgtacgcgcccatcagcaggttctcgcgcacgctcatgtcgccgaacagccgccgcgcctcgggcacggccgcgatcccgcgccgcacgcgctgcggcgtcgcgagcgccgtcacgtcgtcgccgtcgaagcgcacgacgccgcgcttcggccgcatcaacccgaggatcagcttcatcgtggtcgacttgccgctcgcattgccgccgagcaggctgacgatctgccctcggccgacttcgaagttcacgtcgaaatgcacctgcaccggcccgtagaacgtgtcgaggtgttcgagtttcagcagcgcatcggtcatggtcgtttgcaatccggaagaagtggcgctcatgcggctgcctgtgccgcacggtcggccggcgtgccgcccgcatggcggcggccgaggtacgcctcgatcacgcgaggatcgtgccgcacgtcgcgcggcgcgccttcggcgatcttcacgccgttgtcgagcaccatcacgcggtcggacacgcgcatcacgagttcgagcttgtgctcgatcagcaggatcgtcaggccgcgcgccttcagcgactggatcagttgcagcatctcggccgtctccgtctcgttcatcccggccgtcggttcgtcgagcagcagcaggcgcggatgcagcgccagcgcgcggccgatctccacgcgccgccggttcgcatacgacaggctgtgcgccggatgatcgatgcgtgggtgagccgttcgccgaacccggcgatgatgtcgcgcgcctcgtcgcgcagcgcggcttcctcgcgtcgcaccgacgcgggccgcacgagcgcgcgcagcacttcggcagccgcaccgagtgcaggccagcccggccgcgccgcacgcagccgcgcatgcgcgccgatcagcacgttgtcgagcacgctcaggttgccgaacacgcggccgtgctggaacgtgcgcgcgatgccgagcgccgcgaggcgctcgggcgccgtgcccgtgatgtcgcggccgtcgaacgtcacgcggccggcgtcgggccggtcggcgcccgcgatcaggttgaacagcgtcgacttgcccgcgccgttcgggccgatcacactcaacagttcgccgtcggcgagcgtcaggctcgcgccgtcgagcgcggtcacgccgtcgaagcggcgcgtcaggccctgcacgtcgagcaagggtcgattggtggtcatcgcatgcctcctcacaccgtacccagcaggccctgcggccggaaccggacgagcagcagcagcacgaggccgtagatcagcatccggtaatcggccgcccagcggaacagctcgggcagcccgatcagcgcgatcgcgccgacgatgccgccgagcacgttgccgagcccgccgaggatcaccatcgtcagcgcgaggatcgacacctgcgaatcgaaggtctggtgattgatgtagctgtacaggtgcgcggcgatcccgccgctcacaccggccgcgacgccgccgaccgcgaacgcgatcgccttgtagcggttcggcgcgatgccatgcgcacgcgcggcgacgtcgtcctcgcgcaccgcgcgcagcgtgcggccgagatgcgagcgcagcagccgcacctgcacgagcgcgaacccgacgagcaccacgaacgtgaaccagtacgcggcgcgcgcggtgctcgcccacggcagcggcgcgatgccggtgacgccgagcgggccgcgcgtgaggctgtcccagttcaggatcacgaggctcaccacttcgccgatgccgagcgtcgcgatcgacacgtagtgcccgcgcagccggaacgccgggtagacgagcagcgtgccgagcacggccgtgatcgcgcccgcgcacgggatcgtcacggccggcgaccagccgagatccgacgacagcagcgccgacgcatacgcaccgatcacgagcagcgccgcgtggccgagcgagatctgcccgaccgtgcccgcgacgagcgtgaggctcagcgcgagcagcccgtacagccacgcgttggtcagcgtctgcagcacgtacggcgacgcgccgagccacggcagcacggcggccaatgcaatcagcgcgacgagcaccggacgcggcacgcgcacggccttcgcggccgcgaggaaggtgcccgtcatcggttcgggcggcagcgcgcggttcgcgctgaacaggccgttcggccgccacacgaggaacacgatcagcagcccgaacgcgaacaggtcgcggtagctcgtgccgaacagcgcgacgccgtagctctcgacgaggccgagcagcaggctgccggcgatcgcgcccggcacgttgccgagcccgccgatcagcagcgcgaccacgcccttcagcgtcgcctggaagcccatcgccggatcgatgctgttgtagtacatgccgaccagcagcccgctcacgccgccgagcgcgcacgcgatcgcgaacacggtctggttcacgcggtcgacgtccacgcccatctgcagcgccgcgtcgcgatcctgcgcggtcgcgcgcacggcccagccgagccgcgtgaagcgcaggaagccgtacagcagcgcggctgccgcgatgccgatgcccgcgatcagcaggtccagcgagcccaacgtcgcgccggcaatgcgcagatgccagtccggcagcggcgtcggcaccgcgcgcgggtccgcgccgaaggctagctgcgcgagctggtcgaggatgaagctgatgccgatcgtcgcgagcagcggcgcgatgcgcgccgcgtggcgcagcggccgcagcccgatccgctcgatcgcgacgccgagcgcgccgcagccgacgacgaccgccgcgagcgcaaccggcagcggcagcccgaagcgggtcaggcacagccagccgatgaatgcgccgaccatgtacaccgagccgtgcgcgaagttgatcaggtgcgacacgccgaagatcaacgcgagcccgaccgcgagcagcgcgtagatgttgccgacgatgaggccgttgagcgtgtagtcgagccaggaagccatcacgatgcgtccgtcacgtgcatgcggttcggggtcagcgcgcggcgagctgcggtttcgcgccgtcccacagcgcccacttccctgcttcacgacgagatacacggtgcgcgcgcccgcgacgcggcgcgtctgcggatcgaagcgcaccttgccgaagatcacgctcggcacgtcgctgattttcgcgaagccgtcgtgcgcggcctggcgcgtcgtgccgtagcggcgcagcacttccgccgacaggatcagcgcgtcgtatgcgcgtgcgacgaacgaatcgggatcggcatggaacttcgcgcgatagcgctgcacgaacgcctgcacctcggggcgcggctcggccgggaagaagttcgattcggtatacacaccatcgacggccgcgccgcccagttcgaggaatttcggcgaatacacggagccgaccgccgcgatcggcagcgtgacgcccgacgtgcgcgcctgccgcacgatctgcgcgccgtccgcgtagtacgaaatcagcacgatcgaatcgggcttcgattcgccgatgcgcacgagcgtcgaacggaaatccttctccgccggctgatagccttcggccgcgacgacctgcgcgccgaggccggccaccgccttcgcgaagatgtccttgctggtgcggccccagtcggtgttcaggtacagcaccgcgatccgcttgaagccgagctccttcaccgcgtagcgcgcgagcagcggctgctcctcggcctggctcagcgcggtgctccacagataatcgccgcctttcgtgaagtccggatgcgagttcgtgaagccgaactggatcaactgcccgcgctggtagatcggcgatgcggccatcgacgtcgcgctggagaagtcgcccagctcgatcgcgatgcgcggatcggcgacgaacttctgcgcgatcgcgacggcctggcgcgggtcgctgcggctgtcctggaagtcgatcgcgagcggccggccatggatgccgccgctgccgttgatttcgtcgagcgcgagatcgaagccgcgcttccattgttcgccgtattgcgcgtcctggcccgtgagcggcccgctcacgccgaccaccaccggctcgcccgatacgcccgcggcgagcgcgccgcccgtcgacaagccccatgcggcagcgagcgccgccaccgtgcccagcacgcgccgccatgcgccgcgtacgtcgttcccgaaacgttcatgcgtccccagcttcagtcagtcgaaaagagtgagggcatgtaaccatccggttcagagcgatccaacgaagttttgcgtatatcgatatcgggcgcggcgcgaagccggcgacgcccgcgaagggccgcctgcacgcgctgccgcgcgcgatgaggcggcacgcatcgcatcgcgttgattcgattggcgtttcctgtacgtcacgcgtcgccacgggcgtgcctgcgcgcccgtccggccatcgcgacgatcgtgcgcttcgcagttttcgcgctgtcgatagcaaaattcattatatgaatcacgcatgctcacactcctacaatgcgcaaatcgcatcatcggaaggtgtcatggagctgcatcaactcgaagcgttttccgcggtcatgtcggccggcagcgtgaccggcgcgggcgaactgctcggccgctcgcagccggccgtcacgcggcagatccaggagctcgaagccgatctcggctacgcgctgttcgaccggcacggcccgcgcgtcacgccgacgcggcgcgccttcctgctctacgaggaagtcgagcgctcgctggtcggcctgcgtgcgatcgaggcgcgcgcacgggcgctcggcgacgaaaccgccgaacccgtgcgcatcgcggcgacgccttcgctcgcggcgacgctcgtgccggccgcgctcgccgcgctgcccgacggcgcgcaggcgccgcactaccagttgcgcagcgaatcggccgagcatgtcgtgcacgaggtgctggccggcacggccgacatcggcgtcgtcacgctgccgatggcgcatgcggggctcgacgtgcactggatcgcacagacgccctgcgtcgccgtgctgcccgcgggcgacccgctcgcggcgcagccgcgcatcgcgctgcgcgatctcgcgcgccgccgcatcgtgacggtcgcgaaccggcaccggctgcgccagcggatcgatgcagcattcgcggccgcgcgggtcgacgcacgcgtcttcatcgaaaccaatgcgtcgctgaatgcggtgatggccgcgcgtgccggcatcgggatcggcatcgtcgatccggccaccggtgtcgcactgccggtggacggcgtcgtcgcccgcccgctcgacgtcgacatcccgttcgcgttcggcgtcgcgacgccggccggcaaggcgcgcacggcggccgtcgatgcgctgctcgacgcactgcaccggacgacgcgcacactgctcgacgacgtgatctttcacgaggccgccgcgcacgacgcgctgctgcgcggcgaccggctgcgtgccgggcgcccgtcacgtccttcaagtccctcaagtcctgcaagcccttccagcccgccacgcacggcacgatcgcgccgcacgcgcccggaggccgcatgacgatgcccgccgatgcactccacgcactcgaaacccggctcgctcaagacctgcgctggctcgacctgcccgcgccgtcgtgggtgccgccgcgcgaggccgacggcacacgcgtgctcgacgtcgcgatcgtcggcggcggcatggccgggctcgcggctgccgccgaactgcgcctgctcggcatcgacaaccagtgcgtgatcgaccgcgcgccggcgggttacgaagggccatgggtaacgttcgcgcggatggacacgctgcgctcgccgaagcagctcgcgggccctgcgctcggcctgcccgcgctgacgttccgcgcctggttcgaagcgcaatacggtcgtgacgcatgggacgcgctctacaagattccgcgcacgcaatggatggactacctgcgctggtaccggcgcgtgctcgacctgccggtgcgcaacgacaccacgctcgtcgcgctgcgcccgcgcgacgacggcctgctcgcgctcgacgtgcgcggcaacggcgaagcgcagacgctgctcgcgcggcatgtggtgctcgcgaccggccgcgacgggctcggcggcccgtacgtgccgcccgtcgcgcaccgcgcgccgcgcgcgcgttgggcccattcgtccgagccgatcgacttcgcggcgctcgcgggcaagcgcatcggcgtggtcggcgcgggcgcgtccgcgttcgacaacgcgggtaccgcgctcgaagccggcgccgcgcgcgtcgacctgttcttccgccgcgcggacattccgcgcatcaacaagctgacgggcatcggcagcccggggctcgtgcacggctacgcggatctcgacgacgcgacgaagtggcgcttcatgcactacgcgctgacgtcgcagacgccgccgccgcgcgacagcgtgctgcgcgtgtcgcgtcacgagcatgcgcattttcatgcgggcagcccgatcgagacgctcgccgaacatgcggacggcctcgacgtgacgacgccgcgcgggcgctacaccgtcgatttcctgatcttcgcgacgggctttcattcggactggacgacgcgcgcggaattcgcgtcgttcggctcgcacgtgcggcgctggaaggatcgttatcggccggcaccggatttgtggctcgacgaactcgcggaatcgcccgatctcggccccgcattctcgttccaggagcgcgagcccggtgcatgcccggccgtcacgcgaatccattgcttcaaccatgcggcgagcctgagccacggcaagctgtccggcgatatcccggcgatcagcgcgggcgccgagcggctcgcgcgcggcatcgcgagccggctgttcgacgcggatcgcgatcgccactacgacgcgctcgtcgcatacgcgaacgcggaactgcaaggcgacgaatggcgcgacgccgatgcatgagcgcgcgtccatcgaccccatagacgaccaaggaatcccgaacgatatgactgaatccatcacgccggccgatgcgctggacacgatcgatgcggcggccggcctgcgcgacggcgacgcgatcgccgcactgcgccgcgcgcgcgaaaggtgctgcttcatacgcggctgagcgaggctgccctgttcgatcccgcactgcccgatctttcgttgatcgaaagactgcacacggcccggtatgtcgcgcacaagtcgaaggcgccggcattgaccgacacctatcgtgcacggctgatcgacgcgggcggcacgctcgacgatatcgcacgcgcggacgccgatgcgttcgacgcactgcctcgacgcatcggcgcgatccttgcgcatgcacgcctgctgacgctcgcccctgtcgatgcgcgcccgtccgatctcgacgcgctgaagtcggccgggctcacgacgcccgcgatcgtcgcgctgtcgcagctcgtggcgttcgtcgcgtaccagttgcgcgtcgccgtcgccgcgcaggcgcttcaggcacgtaccgcaacggaggccgcatgacgacgaccgcccacggcttcacgtccgacacgctcggctggcgcgcctggctcgacaccgtttcgctcgatgccgcgacgcccgagcaactggccgtgctcgacgcgagccacccgcaagcgaagacatccgactattacctgctgctcgtccacctgcccgagatcctgcggcaacgctcgggcgtgttcaacgcgatcatgtacggccccggcgggctgtcgcgcgcggagcgcgaactggccagcacggccgtgtcgcgcgtgaacggctgcgtgtattgcgcatccgtgcatgcgcagcgcttcacgcagctcgcgaaacgcaccgacgcgatcgagcaggtattcgacgatccggcgacggccggcacgacggcgcgcgaacgcgcgatcgtgcgttatgcgatcgcgctgacggagcggcccgaaacggtcgacgcgagcgatgtcgccgcgctggaagccgaagggctgacccatgaggagattctcgacctgtcgcacgcggtcgcgatcttcgcgtgggcgaaccggttgatgctgacgctgggcgagccggtgtttccggaatcggcgtcactcgcctgacgcctgacgcccgacccaacccgaacacgggctgacgcaggcgccgcccgcgtcacgccttgtgcgtcgacagcaagatactcgtctcggtattcgcgatcccgtcgatcaaccggatcgcgccgagcacgcgatcgaagtgctcgagcgaatcggcatgcagctcggcgacgagatcccagcgcccgttcgtgctgtggatcgacgtcacgttcggatgcccgcgcagcaccttcaccacttccgcgccgcggttgccctgcacggcgatcgacatcagcgcgcggatccggtggcgttccgccgccggcttgagccgcaccgtataaccgacgatcacgccgtttttctccagccgcgtcagccggttctgcacggtcgcgcgcgcgacgcgcaatgccttcgccagcgcgacgacgggcagtcgcgcgttgtcgcgcagcagcgcgatgagctgccggtcgacatcgtcgagcgtaatcatgggtggaccttcctgttaaacgtgaaccggccgccagcgtgccggaggctgcgcattccgcgccagcgaaacttgtcaaattgccggatatggctggcattctgccaagtctatcgataaatctgccacttttgctgtctatttgttggctcgactcgcggaaataatgacgtatcgaccggccggacacgccgcgccgccgctttccggcaagcccgcgccgcgccgaagcaccgcccggtcgaccagaacgccagggacatccgtaccggcactgagaacatggagacagacgcatgacccgcttcctcgacgttcccgccaccgcccgactgatcgccaaaaccggcgtcacgacgttcctgcgcgaactcgtcgacacgctgcgcgccgattacctgcactgggccgatttcgacaagtcgccgcgcgtcgcgtgccactcgcgcgacggcgtgatcgaactgatgcccgtcgcgaacgcatcgctgttcgcgttcaagtacgtgaacggccaccccgtcaacgccgcgcgcggatgcacacggtgatggcgttcggcgcgctcgccgaagtcgacaccggctatccgctgctgctcgccgaactcacgctcaccaccgcgctgcgcacggccgccacgtcggtgctcgccgcacaggtactcgcccgccccgacgcgcgcacgatggcgctgatcggcaacggcgcgcagagcgaattccaggcgatcgcgttccatacgctgctcggcatcgacgaaatccgcgtgttcgacgtcgatccgcgcgcgaccgacaagctcgtgcggaacctcgccgcgtacccggcactgcgcgtcgtgcgtgccgcatcgaccgccgacgccgtgcgcggcgccgacatcgtgacgaccgtcaccgccgacaaggcatacgcgacgatcgtcacggccgacatgatcgagcccggcatgcacctgaacgccgtgggcggcgattgcccgggcaagaccgagctcgaagcgggcgtgctgcatgcgggccgcgcgttcgtcgaattcgagccgcagtcgcgcatcgagggcgagattcagcagatgccggccgacttcccgtcaccgaactgtggcgcgtgctgcaacgcgagacgaccggccgcgaacgcgcggacgaagtcacggtgttcgactcggtcggcttcgcgctcgaggattattcggcgctgcgctacctctatgcgctcgcgcagcagcacaacgcgggcgtcgagatcgcgctgattccgccggccgtcgacccgaagaacctgttcgcgctgatcgacgacccggccgcgatcgcgcagggtcacgcggcatacgtgaccgaagccgtcgccgcgttcgcgcgctgaccgcgatgcccgggcggcaggtgcgccgcccgttttcctgcccttcgttcctgcctgtcatgaatctcgtatcgatccaggcgccggccgccgtcgtgatgatccggccgcaccgcttcctgccgaacccgcagaccgcggccgacaacgccttccagcgcacggccggcaacggcgcgcccgacctgccgtcggtatcggccgccgcacgcgacgaagtcacggccgccgcgcagacgctcgccgatgcgggcgtgcgcgtgcatgtattcgacgaccacggcgagcgcgacacgcccgactccgtattcccgaacaactggttctcgacgcacccgggcggccatatcgcgctgtatccgatgtacagcccgaaccgccgccgcgagcggcgcgcagacgtgatcgagatgctgaaggccgaatatcgcgtgcaggacgtgatcgactactcggccctcgaatacgatgacgtgttcctcgaaggcaccggcgcgatggtgctcgaccacgtcgcgcggatcgcttacaccgcgcgctcgcgccgcgccgatccggtcgcgctcgaacgcttctgcacgcatttcaatttcgagccgatctgcttcgatacggccgatgccgacgggcgcgcgatctatcacacgaacgtgatgatgagcgtcgcgaccgaattcgcgatggtgggcctcgacctgatcgccgacagccggcgtcgcggcgaaatcgcgcaacgcctgaccgaaacggggcgcgcggtaatcgcgctcgatccctcgcagatcgcgaatttcgcaggcaatacgctggaattgtcgggcaagggcgggcgtgtgctcgcgctgtcgcggcgcgcgttcgattgcctcacgcgcgaccagcgcacggtgatcgagcgctccgcgcggctgctgccgctcgacgtgccgacgatcgagctggccggcgggtcggtacgctgcatgctcgcggggattcatctcgcgcggcgcgccgttgcgccggacgcgatcgccgtggagtcggccgcagcgttgcgtgaggcgatgccgcaggtctgaccggcgcacgacccgtgcaaacgaaaacggctgccgatgcatcggcagccgtttttcaaggtcgtcgaatacgtgagcatcgacggcacgctcaggcatccggacgataccgtcgccccagtgcgccgctcaccccgccagcaacttcaacccggccggcagcgtctcgccgaacacgcgcaccgtgtcggcttcgtcgaacgcgatcgcttcacgcaccatgtcgatccacgccgacgatgcattcgcagccgacaggcgcttgattaccgcgtcgcgcgtcacatccggcaaatcccgcgaacggtctccggtcatccgcgcaatctgcgcagcggcaaacgcggccggctcgacctgcttccagtcgagcgcgaacagcgcatcgagccagccaccggcgacttccgccggcacgacgctgtgcgcgctgccgtaaaacggccggcgcgcaccgatgcgcccgagcgcccacgcgcacagcgcacgctcggcaggcttctgcaattgcgcgatcaggcgttcggccagttcgaccttgcgctcgacgggcagccgttcgagcgacgcggacagccgcgtcatgtcggccgggccgaccttgcccggatcgaacggcagcttgcgccgcttgtcgtcggacggttcgaggaacgcgatcgcgtcgcgcacctgcgtctgcgcatcgtcgtcgaggccgccggccacgcgccgccacagcgtccaccactccgaccacacctgcccgtcggtcacgtactggatcccgtcgtcgaacagcggccacagctgctcgatgcgccaggcatcgagcggatgaccgaaacccggacgcaggcaataaccggcaaggttcagccacgcacgctcgtgatcggccgaacggcggcggcggcgtgcgcgcgcgagcagcgcgtcgaacagctcgcgcgcgagcgcgacgtcccacgcttcacgcgcgccgagcagttgttcgagttgtgcgcgcaaccggcgcgtgtctttcggcgcgacacccgcagccttgctgccgaacgagcgctcgatcagctcgatcgcctgatcgagccgcggatgtcgcccgggcgcggcgtcgtcgccgtgcaccggcgcatcgccgcgcaactggaattcgagcttccagcggcgcgccgcgtcgtcggtcgcgatgcaatgcatctcgagcgtgccgacctcggtcagcgacgcggtgagcttcaccggcgtttcgcgtgcgtcgctgcccgccttcgcgtcgacgaccgtcgcgatcggcggcagccgcacgaaatcgccaccgtcgagatcgacgagatcgccgggccggtacggggtctcggccacggtcgacatcaagtgaaaacgcaccggctgcccgagctgcaacgcgaacgtgcgatcgtcgagccggatctcgcggccctcttccgcaccgcgcggcagcaggcagacgccgcgcgcggcggaatcggccgcgccgtcgtcgagcacgaggaaatagctgcgcgcggacccgccgccgatgcgcggcgcatgcccggcacgcgcgagcccgtacgcgacggcgccacgtgcgacggccacgtccggatgcgcattgtgcagcacgtcgagcggtgcgccgcgccatgcgccgagcgtttgcgcgagacgatcggcaagcgcgcccgcgcggaacacgccgccgttgagcagcagcgtgtcgggcagcgggccgtccgcatggcgctgcaggaacgcggcgacatgccgcgtgacggccgcgtcgctcgcatacggcagcccgaattcgacgatcgcggcacgcgcacggcgcggcagctcgccggcttcgacctgcggaaagaacccgtcgacgacgatctgctcgacttcctgccgcgtcagctcggccgaacgcgcaccgccgacgagcctgctgcccgcgccgagcagcgtgacggtgaccgacgccggcgcatcgtcgccgagcagccgctccttcgcggcgcggcagcgctcgacgagctgcgacaggctcgcggccgacagccgcgtgccgggctccgtcagccgcgtctcgaccaggcgcgcgagcgcgaggtccatgttgtcgccgccgagcatcaggtggttgccgacgccgacacgcgtgaaggtgggctcgccgtcgtcgcccggcgcgacatcgacgagcgtgaggtcggtcgtgccgccgccgacgtcgcagatcagcacgcgcgcgcggcggcaaacgtgtcgcgcagcgtgtcgcgctggccgtacagccagtcgtagaacgcggcctgcggctcttccagcagccgcagcgcgggcagcttcgcgcgtcgcgcggcctcgaccgtcagtgcgcgcgcgccgtcgtcgaacgacgcgggcaccgtcaggatcacgtcctgcttcgcgagcggcgcatcgggaaacgcgcgtcccacgcatcgcgcacgtgcgcgagataactcgcgctcgcatcgaccggcgacaccttctcgacgccgtcggccgcgccccacggcaggatcgccgcgagccggtcgaccgacgcgtgcgacagccagctcttcgcgctcgtgacgagccggcccggcacctgcgcgctgagcgtgcgcgcgtagcggccgatcacggccggcggatcggcggccgcgctcgcgtttgctttcgcggcgaccgtccacggcagccgcaacgtgtcaggcggcagctcgcccgccgccgggtgatagcgcaccgacggcagcagcggctgcgcggccaccgcgccggggccgaccaactgctcgacgtcgaacacgcggatcgcgtcggaaccggcctcgacgtaagcgacgaccgtattgctcgtgccgaggtcgatcccgaccgtatagcgcttcatcgcgctcaggcggcgccgcgcacgtcgaactcgaccttccagcgctcgttcgtgccgctcgggatcgcctcgagttcgagcgtgccggcttcggtcacgcgcgcatgcagcttcacgggcacgacctcgccgacggtgcgcccttcggccggcagcgtcgcctggatttcctcgagctcctgcagctcttccggcgaccagtagtcgagcagcgtgccgacctggtcctggcggcgcaccgacgaaccgaagaagcggaactgcaccggttcgccgacgacgaggccgaactcctgcggcggcagcgccgcgtccgagccttcctccatcccgaacggcgcgacgcacagcgcctgcaccggcggctcgagccccggcaccgcgggcatcgccgattcgatcgcgacgtagtacgcacgcgccgtgccgccgcgaatgcgcacgccacggccgcgcttcacgtagccgtagtacgcggcgccgcgcgcgaccgcgagatcgagatccgcgccttcgagcaggcgcgcgggcggcagccttcggcggcgagccagtggttgagcgtatcgagcacgcgctgcgtgagcagcgtcgacttgaacacgccgccgttgaacagcacggcagtcgggtgcaggaacgtcgcgccctgcggcagcgtgcgctgcacgccctcgagcgagtcgagcgccgcgacctggcggccgaggaacgccgcgagatggcgcgtgatgcccgcatcctgcgcatacggcaggccgagctgcgtcaggccgacccgtgcgcggcttaccggacgcgcggctgcgtcgacctgcgggaagaagccttcgaggatcgtctgcgtgagttccgcgcgcgtgagctccgtgcggatcgacccgccgatcagcttcgagccgcggctcggcacgacgagcggcaccgcgtcggtcgacggatcggacagcagcgtttccttcgcggaacggcatgcgtacgtgagcgcccgcagttgccacggatcggcctgcgtgccctgctgcgcgagcttgcgcgcgacgacgtgcgcgagcgcgaggtccatgttgtcgccgccgagcaggatgtgctcgccgaccgccacgcgatgcagctcgagattgccgtcgcgctcgaccaccgcgatcagcgacaggtcggtcgtgccgccgccgacgtcgacgcacaggatcaggtcgccgacctgcacctgcttgcgccagccgccctggctcttctggatccagctgtacagcgcggcctgcggctcctcgagcagcgtcatccgcgaatagccggcggcacgggcggcctcggccgtcagctcgcgcgcggccgggtcgaacgacgcggggatcgtgaccgtcacgtcctggtcggcgaacggcgcgtcgggatgcgcgtggtcccacgcttcgcgcaggtgcgtcaggtagcggatcgagctttccagcggcgacacgcgcgacacttccggcggcgcatcgctcggcaggatcgccgcgcggcgatcgacgcccgggtggcacagccagctcttcgcgctcgacacgaggcggatcggcgtgcccgcgccgcgcgtgcgcgccatctcgccgacggcgaaggcgcgcgaggccgtccacggcagcgtcaggtcgccctgcgtgagttcgctttcatgcggcaggtagaggaacgacggcagcaggtcgcgcgactccagcgcgccgggcgcggtgagctgcgcgatcggcagcacctgctgcgtgatggtttcgccgtcgctcgcggcgctgtcgacatacgacagcgcgcagtgggtcgtaccgagatcgataccgatcgaatagcgcggatcgctcacagttccacctccgccggtgcgacgaccgaggcgtcgtggctgcccgtcagcttcggcaggcgcacgtcggccacccgccagccgcgatggctgaccgtgcccgtgaacggcgccgagccgaccacgttgcccgtcacgcgcacggccgtcgcgtcgaagccggccggcagcgtcacgcggctgccctcggcttcgtcgcgcaccggcacgatcgtgaagtgttcgcgcagcgcggcacggcagccgtcgtgcacgaggcgcgcggccgcgccgatctcggcgtccgcatagccggcgatgtcttcctcgacgaagtcgatgaagcgcgcatcgcgctgcagcaggccgagcagttgcagtgcggcctgcgggctcgcttcgcgcagctcgggagcaggcgccttcacgggtgcaggggccggcgcaacgggcgcggcagccggggccggggtcggggtcggcgcgaccggcgccgggcgccgtcgcgcacgcgcagcacgccggccgcgaactcgcggttgccgagcacggagaagaacgtgccgacggcaagcgacagccggccgaagaaggacaggttggattcgggcatgaggtctggactcctgtgggctcgcgacacggcgagcgatcttgcctgggcgcccggcggcggcgtgcggattgcgcactgccgccgtccggcgcgtgattcggtcgcgccctcgcgggtgcggaaaacccgtattttgccctgtggcgggcgaaccgggcagaagttggggacagaacatcgcggcgcgacggtttcggccgcgccggcgcgcacggcggccgtgcccggccgcgatgctgcagcgcgtcagcgcggcttgcgccgccgggccgccttcgcttcgaaatcgcgcgacagcatgccgagcgtgacttcgccgaagcgggcgagcagcgtcgtctcggcctctttcagcgtggccgacaggtgcgcgttgacggcctgctcgaccaggcattcggcctcgtcgtcggtaacgagatcggagaacagcggcggctcgcccaccgcgccatagacgtcgagcagcgtgatgtcgtcgagcgcgacactcagcgcccacccgccgccatgccccttctccgactgcacgtagccgtggtcgcgcaagccgccgagcaggcgtcgcacgaccaccgggttcgtgcccagcatcgtcgcgatcgtctccgacgtcagcgggccgtcggcctggtccatgtggatcagcacgtgcagcatgcgcgacaagcggctatcggttctcacgggcggcgccctctctcgaaacttttgaagttgcgtgaatgataccaccgccctatcatgcaacttctcgtgttccatgagttggatgccatcggaacacgtccttcacattcacgcaggttcaggaaaggagcgggtgcatgcatgaccatcatgaagtgatcgtgatcggcggcagctttgcggggctgtcggccgcgatgcagcttgcgcgggcgcgccgccgcgtgctcgtgatcgacgccggccggccgcgcaaccgctttgccgcgcacgcgcacggctttttcgggcaggacggcaagccgcccgcgcagatcgtcgaggaagccgccgcgcaactcgccgcgtatccgaccgtgcagcggatcgcaggcgacgtgcgcacggccgaacgcgatgcggacggccgcttccatgtgacgctggccgacggcagccgggccggcgccgaccggctgatcctcgcgaccggcatccgcgacgaactgcccgcgctgccggggctcgccgaacgctggggcgtcagcgtgctgcattgtccgtactgccatgggtacgaggtgagcggccggcggctcggcgtgctcgccacgcatccgctgtccgtgcaccaggcgatcctgattccggactggggcccgacgacgtggttcacgcagggcgtggtcgaagcgaaccacgaagaagccgcgttgctcgacgcgcgcggcgtacgcatcgagcgctcgccggtcgtcgaaatcctgggcgacgcgccgcgtatcgaagcgttgcggctcgccgacgggcaggtcgtgccggtcgatgcgctgttcgtcggcgcgcgtacggcaatggcgagcgatctcgcgcagcagctcggctgtgcattcgacgacgggccgctcggccctgtcgtgcgcgtcgatgcggggaaagagacgaacgtcgccggcgtgttcgtggccggcgacgcgtcgacgccgatgaccaacgcgacgttcgcgtcggcgtcgggcgtgatggccggggtcgccgcgcatcggtcgctgatagtcgggctgcgcgcgtgacgcggcgcgcagccccggggcacacgatcaggacttcgcgatgttctcgagcatgtggcgcgcatcgttgatcagcacgccgaagtcgaccgtatccggcgcggtttcgacaccggtgatcaccgccgtgatcaccgccttcgacccgttgtggtacggatacacctgcgtgacatacgtcatgtcgcgaccatgcagcgtggacacgaagtagctgctgtagatcttgcccgtcacgggatcggcccagccctgccgcgcggtcatcggacgcgcgagacgcatgaagttcgcggtcaccgattccgagttgtacggcgaatccacctcgaagcggtagacgatttgcagcgacgtcaactgcgtgcgcaggtcagcgtcgttgaagttcggcaccggaaacttgccgatcagcccctgctgataggcattgcgcgtcatcggctgaaacgcgacctgataacccttcggcgattcctgcacgttgaagttgacgtcgtacttcacgcctgacccggcgaccccgttgtccgtacgcgcatggacgacgaacgatccgggcgtcaggttctcgaagcgaagccggtagtactgcgcgttcgcgatgacctgcacgctgcggctgtcgtagccgacatcgcggacgatgaccgtcgaatacggcgcgaccttgcgcggctggatgccgggatcgttcggaatcttcaggacgaccggcttctggctcgacacgtcggtccggcccgcgtcggacgtcagcgcgcccatgatcccctggccggcctgttgaagcgggttcgtcgcgccgcacgcggcgagcgaagcggccgcgacgacgattgcgaggcggcctgccagggacgggtaaagacggacttcataaggtgagaggctccatttttcgttggaataggtcccggccttccacggcatgcaccgtgctggtctggacacgctgcacagaaagccggacgtcgtctctatatcggcgcaacgcgaccgttctttaagccgtcgacaccggccatgtcgcccgcgccgccgcctcgatggctacgacgcgtgatatgcggtttaatgccctgcatcgttcacattaagagacacgaaatgctcgacctcgacgaccttcggctcgtacgcgcgatcggtacgtcgcgctcgctggcctccgccgcccggctgctcgatctcacgccgcccgcggtcacgatccgcctgcagcggatggaggcgcgcctgaacgccaggctcgcggtgcggcagccgaaagggatcgcgttgaccgacgaagggcagcggctgtaccaggaagccgtcgacattctcgagcgcgtggacgcgctgccggtcagcatttcaggcgaccacggcgacgtgcggggcacgctgcgcgtcgtcgccccgctcggcttcgggcgaaagtacgtcgcgcggatcgtgcgcgacctgcagcgcgcgcacccgaaactcgacatcgcgctccacctgtcggacagcccgttgaccagcgcgtcgggggccgacgtggtcgtgcacgtcggcagcctcaagtcgtcgtcgtggatcggctatccgcttgcgcccaacgagcgatttctgtgcgcgagccctgcctatgcccgtcgcatcgaggcgttgaaccatccgtccgacctggcccgatacgactgcctgtgcctgcgcgagaacgacgaggacatcccgcgatggcgcttctcgtccggcggcgacgtcaagggtgcaccacgccggtccgccgtgatccgcgtcaccggcgcgctgtcctccaacgacggcaccgtcatcaccgaatgggcgctggccgggctcgggatcgtcgagcgctccgagtgggacgtcgctccgctgctggcgaacggcaggctcgtccggttgctgcccgactggcacctgccgcccgcgccggtcacggcgctgctgccgtcgcgcaccggccgttccgcgcggcaacgggtattcctcgaagccgcgacgcggttgctgagcccgccgccgtggcgcggcaaggcatgagtggcgccgagcccggactcgggttcgcgcgatccggtcgattaaacggtgtttaatgacggattagcgttgcgttaaacacgcggcccgtcgacacctctacagtgttcgcaccggcaacattccgaggcaacgcatcgtggaccttcaaaccctcaacaccccggccgccctgatcgacgtcggccgcatgcgtcacaacatcggccgcatgcaggcacacctggatgcgctcggcgtcaggttccggccgcacgtcaagaccaccaaatgcacgcacgtcgtcgatgcccagatcgccgcgggcgcgcaaggcgtcacggtgtcgacgctcaaggaagccgaacagtttttcgcgcacggtatccgcgacatcgtctacgcggtcggcatggtgcccgcgaagctcggccaggcgctcgcgctgcgccggcagggctgcgacctgaagctggtcacggacagcctgccggctgcacacgcgatcgtcgaattcgggcgcgcgcatggcgagcgcttcgaagtgtggatcgaggtcgacgtcgacggccaccgctcggggatcccgcccgacgcgggcctgctgatcgacgtgggccgcgcgctggtcgacggcgggctcgtgctcggtggcgtgctggcgcacgcgggctcgagctacgaatacagcacgcccgaagcgctggcggccatcgccgaacaggagcgcagccgcaccgtgcgcgcggcagaacgcctccgggccgccgggctgccctgcccggtcgtgagtatcggctcgacacccaccgcgctcgcggcgcgacacctcgacggcgtcaccgaggtgcgtgccggcgtgtacgtgatgttcgacctcgtgatgcacaacatcggcgtgtgcgacctgtccgacatcgcgctgtcggtgctgaccaccgtcatcgggcaccaggaagagaaaggctgggcgatcgtcgacgcaggctggatggcgatgagccgcgaccgcggcacgcagcgtcaggcgcgcgatttcggctacgggcaggtccgcaccgaacacggcgacgtgctcggcgactacgtgatgagcgccgccaaccaggagcacgggatcgtgtcgcgcgcgagcgcgcccgactccggcatcgcgcaacggtttccgatcggcacccgcctgcgcatcctgccgaatcatgcgtgcgccaccggtgcgcaacatcccgagtatcaggcgatcggcgacgacggcagcgcgcaggcgtggccgcgcttctacgggtggtgagccgaaccgcgcgcccgcaccgtgtcgccgatacattgactatttgtccaaatctggacaaaatttaaacacctcgttttgcattgcgccgaaagcgcttgcccgaacatgccgacagacgcccgactcctgcttctcgaccgcgatgccgtcgaacccgccctcgaggccgcgcaagtgacggcggcggttcgcgaagccttcgtgctgcacagtcaacgggccgggcgcgtgtttccggtagttcgcgagaagctgcacacaggcggcgtattcgggatcaagtcgggcgacgtcgcgcgccaggaactgctcggcttcaaggcggccgggttctggcccggcaaccgggcgctcggcggcgaaccgcatcaggccaccgtcgcgctgttcgatccggccacgggccgcccgctgtgcatcatggacggcaatgcgatcaccaccgcgcgaaccggtgccgccggcggcctcggactgcaactgctcgcgcggcgcgacagcacgcgaatctgcgtgttcggtacgggcgtgcaggcgcgcgtccagctcgactacgcgctcgggctgctgccgcaacggtgcatggtgcggtacgtgaacgtcagcggcgagcccgacccggagttcgaatcggcgttccgggagcgatgcacgatcggcgtggcacgcgaccggaacgacgcggtggccgacagcgacgtggtcatcacggccacaccgggcggcggcgcgctgttcgatgcggatgcggttcggccgggcacccacctgacctgcgtcggcgccgacacggccggcaagcgcgagcttccggcaggcgtgctggaacgcgcgcgcatcgtcgtggacgatcacgatcaggcccgcagcatcggcgagtgccagtgggcgccggatttgccacgcactgaaatcggtgacatcctcgccggaaccgcgtcggtcgaccgcgcgccgcacgagatcaccgtcttcgacatgaccgggctggcgcttcaggacctgaccgtcgcccgcttcctgtatcgacaggccctcgaaaacggcaccggaatttccattccgtggccgtggtaaacgaaaccctctcgtcaaccgccatgcgtctcgccaaagtttccgccctctcgttcgacctggacgacaccctgtggccgttcgggccggccgtcgtacgggccgaagcagcgcttcacgcatggttgatcgagcacgcgcccggtaccgcgcgcgtgctgtccacgcagcaggcgctgagcgggttgcgtgaggaatacgaacgattgtgccccgggctcgccggcgatttccgtgcgatgaggatcggatcgatccggcttgcgctggagcgtgcgaacgaggatgtcgcgctcgccgagcacgcgtacgcggcgttctttgccgcgcgcaaccgggtcgaattctatgacgatgcgttgcccgcgctcgcgtggttgagcgcgcggtttccgttgatcgcggtgaccaacggcaacgccgacctgcgaatgaccggcggcggcgaatactttcgtgcgacgctcagcgcgcaggcgttcggggtcgcgaagccggagcccgggatcttccatgcggcggcggaaacgctcgacgtgcagccggcggaactgctgcacgtcggggacgactatcacctcgatatcgtcggtgcgttgaacgcggggcttcaggcagcgtgggtggttcgcgacacgcatccggaaccggaacgtgtgcagcaacaggccgccgcgccgcaccttacgctcaacgacctgtcgatgctgtgtcgcgcgctcggcgggcccgacgacgtagcgtgagcgcaagcgcctgcgtgcgctgcgcgcgcgacgcacgctttaacgccatgacacgcggccggcaggaattcgaccactgcgcaaacggaacggccggcctggccgatgcggcccatggccggccgccgcacgctcacgccgccttgcgcgcgtccgcgatccgctgcggcgccttcggccgcgcatacagccgttcgaggtacgcccgcagctgcgggaacgattcgatcaggttgcactcgccggcccagtcgatcaggtaagccgtcacgcagtcggccaccgtcagcgtgtcgccgacgatgaactcgcgcccttccagatgcttgtccagaatcgcggccatcgtcctgaaatcctcgcgcgccagctcgatgtcggccggcgagcgcttctccggcggatagaggaacgaatgccgcgtgatccgccacagcggctgctcgagctcggtcaccgcgaacatcacccaccggtaggcctgcgcgcgcagcgccagatcgaccggcagcagcgccttctccgggtacttgtccgcgagatgcagcacgatcgcggccgattcgggaatcacgaggtcgccgtccaccagcacaggcaccttgccggccggattgaggcgcaggaattcgggccgcttgtgctcgccctggagcaggttcaccgagacgaactcgaagtcggcatccagctccttcagcccccacagcgcgcgctgagtgcgggtgccggcaaatccgtaaagcttcatcgccagtctccatccagaatgtcggaaatttccgcatgccggccacggcgcctcgccgatccgcaacgcctggcctcgctggtcgtttacgcgccgggaatcgccagcaccggcatcacgtcgatcgccacgcccgggaacagcgtgaaatgcggatggccttcgaacaatgcagcggccgcgtcgtgcgacgccgcccgcacgacggtaaagccgctcatcgcgttcgccgtgtcggtgacgccggccgcatcgatcgtcttcgtcttgccgagcggcccgcccatctcgacgatcgcgtcgcgattgcggtcgacccatgcatgccacgcggcgatgccgtcgcgctcgcgcgtgcgccgctcgtcatccggcagcgccagccaggccttcatggccgggctatccttggcgccgagaaataccgcgagatacaactgctgttgagcactcatgccgcctcctccggtgacgggcacgacggactgccgcgcctcgaccttgacacgataggttgatatcaacacaattgcaacatggcacgaaaagaaaagctccctttcgaaacgacgctgatggtgcgcgattgctgcctgtgcctgcacatgcagcgcgcggcgcgcaatcttgcgcggatcttcgacgatgtgctgcgcccgctggacctcaccaacggccagttttcgctgctgatgtcgctgaaccggccgcagccggcgccgatgaaatcggtcgcatcggtgctcgcgatggatcgcaccacgctcacggccgcgatcaaaccgctcgagcggcgcggcctcgtcacgatcgcgcaggacccggacgaccggcgcagccgtctgctcgaactgacgcaggccggccacgacctgctggccgaggcatttccgctgtggcagcagacgcatgccgagatcgaacggccgttcgcaccggggaagtcgatcagttgcgcggccagttgcgtgtgctgtccgtcgatccggccgaacgcggctgaacggaaccggcgcgcgacttaccgcggcaggccggcctgcttccggcccttcttcggcaacagcagttgggcgaattcctgcaggaaggccacgggcccgtgcgcatgcagcgcctgcccgctgctcagcgcgccgtcgatgacggtcgcgagccgcagcgcgaaggtttccggttcgtcgacgcccatcgcgcccgccagttcggtcagccggcgccgcagttcctgcttgtgcgcgacggccaccttgcgggccggatgattgccgtccgcgtattcggcggcgatgttgatctgcgggcaaccgcgatagccggggcgcgcgatgcgttcaccgatccattgcaactgcgcatccagttcctcgcgcggcgtgcgccggtaccgcgcggccaccgcatcccaatgcgcccagaaatcggcatcctcgcgcagcaggaacgcttcgatcaggtcatccttcgtcgcgaagtgacgatagaggctcgtcttcgccacgcccgcctgcgcgacgatcaggtccacgccgaccgcgcgcgtgccctcccggtagaacagctcgctggccgtttgcagaatgcgttcgcgcgtatcgggcgcgttccctggtgtacctgtttcctttttcatcccgacccggccatgctggccgcccttgccgcaacagtgagccgatcatagcaccgcgggattgacgacgatacaggtctgtactataaaacagaccgttctgtatcggagttgatcatggatgatcgaatgacggttgcagtctatggcgccacgggtcataccgggcggtttgtcgtcgccgaactggcacggcgcggcctgcgcgcgatccgcatcggccgcgatgcggcgcggctcgcggaaggcggcggcgaagcgtcgctcgcgcgcgtcgccgcgatcgacgatccggccgcgctcgacaccgcgctgcgcggcgcggataccgtgatcaactgcgcggggccgtatctcgataccgcgctgccgctggccgatgccgcactgcgggccggcatcccctatctcgacctgacggccgagcagccgtcggtgctggcgctggccgaacactgcgatgcccgcgcacgcgccgcgggcgtgaccgtcgtgccggccgcggcgttctacggcggcctggccgacctgctcgtcacggccgtcgtggacaggaacctgccgatcgagcgcgtcgatatcgcgaccgggctcgaccgctggcacccgacgcgcggcacgcgcgtgacgggcgaacgcaaccgcgcggtccggctcgtgcagaaggacggaaagccgacgccggtgccgtcgaccgcacgcgaacgcgcatggccgttcccgccgccgatcggacgggtcgacgtcacgctgctgccgttttcggaagtgatgacactctcgcgtcacctgcgcatcgatacgatcgaatcgtggctcgcgacgctcgcgctgcgcgacgtgcgcgatgccaccacgccgccgcccgagccgaccgatgcgctgggccgctcggcgcagcagttcgcgatggacgcgatcgtcgtgcaagggagcacgacgcaccgcgcgaccgcgtccgggcgcgacatctacgcggtcagcgcaccgatcgtcgtcgaggccgccgtgcgcctgatgacgggcaacagcgtggtgtcaggcggcgtgcgcagtctcggcgaactgttcgacgcacgcgactttctcgcggcgctcgattcggtggcagtatcgttcggcacgacgaccgatccggttttccacaaggagacacacacatgagcagcaacgagaaaggcgcgtatttccggtcgcttcaccgcgcgggccagccgctggcgctattcaacgtgtgggacgccggcagcgcgcgcacggcggccgacgcgggcgccgtcgcgctggcaaccggcagctggtcggtcgcggcggccaacgggttcgtcgacggcgagcagatgccgcgcgcgctcatgatggaggtgctcgagcgcatcgcgcgcgcgaccgacctgcccgtcaccgtcgatctcgaaagcgggtacggcgagcggccggaagatgtcgccgaaacgatcgcgctcagcatcgaggccggcgcgatcggctgcaacctcgaggacagctttccggcgacgggcgaactgcgtgacgtcgaagccgccgcagcgcggctcgcggcagcacggcaggcggccgatcgcgcgggtgccgactacttcatcaacgcgcgcaccgacgtgttcttcaaggcgccggccgacacgcacgacgagcgcctcctcgatgccacgctggcccgcgcacgcgcgtacgcggcggccggcgccgacgggctcttcgtgccggggctgcgctcgccggcgctcattcgcgcgctgacggccgcatcgccgctgccggtgaacgtgatgcgcgtcacggaaacgccgacattggccgaactcgcggaatacggcgtggcccgtatcagtcacgggccgtatccgtacctgcaggcgatgaagacgctggcggagatggtcaggcaaggcggctgacgcgcgttgtcccttggtacaggggtggccggcactgcgatgccggccgtacacgacgacgaccatcacaggtcgccgggtttctcccagaccttgacacgcgccatcgctcgctcgacgtcatccatgtcgtcggcgccgagcgacaggtcgaatttcccggtgatgatctttctgacctcggccagccgccgggtcacgccgccctcgtcgatgaaccggttggtctcccgcgcatactcctgatccgggcctgcggctgccgccgggccagcgtgatagtagcggccgatattgcgcaacgaaatgaggatgtattcgatctccgtgagcacacgcaacgcctcgtcgccggacaacccgatcgtttcgttttccttcttcatttcgcgttctttcgcgctcattcgtcggttgcctcactatttgcggacgttgattccgtcaggcccgatgtcgtccacgagttcgatcgcacgaacgtcgaacgcgggatcgggcgcccttccggccagcgcctgaaaaagatcgcgaacatatttctccttgtccgtcacgtcgtccagcggaatcgcgtgcggcacgatgccacgccagtgcgccagccatgaacccgaagccagcacatactccagtgcgtcgacgacacgcgcccgggattcagcgccgtatagcccgaaccgggtcttcatctgccggagcaaccacgccctcccgtcatcggagttgatgtagaaatcgtccagctcgtcatcggtcatgatgaacaagcagccgtacaacggcctcagatagtgaaaatcgattgccttcttcatagaaccgggcactccacgaacgcagttgccatgtgaaaaagtccgggagcccatcgtgctgcgcatgcgaacggccaatgcgttcgccgcgccctctttgccggaccacgatcgcccgcacttccggctacgggcgccaacacgggccacgaatggcggctcatcatacgatcgaatacatgcgccgggtgctccagcgcgctgaaccgcagccttgcggacctcgaccgcatcgcgggcgccggcaccgcctgacgctcgactggcggacggccgccggcgggcctgcaccaccgcgccaccgcaccaccgagcaggcctgccggccggtcaggacgcggcgacgccgacccgcttcggcacgcccgtcacgatcgccgcgaccgcgacggccagcacgacggccgcgcccacgaacacgccagccgcgccgttcgcgtcgaacacgacgccaccggccgccgcccccgtcgcgatggcaagctggatcgccgcgacgatcagcccgcccgcactttcggcttcatcgggcacggtgcgcgtgacccaggtcgaccacgcgaccggcacgccgccgaaggccatccccacaatgcgacgagcaccgcatcgatcatcggcgcgcggccgagcgcgacgagcgcgacggcgagcacgaccatcagcgcgggcatcgcgatcagcatcggccgcagccggtgttcgagcacgcggcccgcgagcgacgtaccgacgaagttggcgataccgtagccgagcaggatcgccgacaggccgttcacgccgacgcccgcgacctgttcgaggaacggccgcagatacgtgaagaacgcgaaatgcccggtgaacacgaggatcgtcgcgaacatcccgaggccgacggtcggccggcgcagcacgtcgatcagcgtccgcagccgcgtcgtgccgctcggcggcagcgacggcagcgtgacgagctgcgacacgaacgcgatgccgccgagcgcgcccgcgatcaggaacacgttgcgccagccgatcaggtggccgaagtagctgcccatcggcgcggacgcgatcgtcgcgaccgccacgccgctgaagatgatcgacagcgcacgcggcaccatcgccgtcggcacgagccgcatcgtggtggccgtcgccatcgtccagaagccgcccagcgcgacgccgagcacgacgcggccgatcagcagcatcgtcaggctggtcgcgaacgcgaccgcgagattcgacgcgacgagcaacaccgaaaacgcgagcagcacgcgccgccggtcgatcgtgcgcgtcaccgcggagatcaggaggctcgtgacgagcgccaccgtcgcggtggccgtgacggcctgcccggcgacgccttcggtcacgccgaggctctcggccatcggcgtcagcaggctcgcgggcaggaattcggccgtgacgagcccgaacacgccgagcgccatcgcaaataccgcgccccaggccggttcgcgggggccgccgtcgcggcgacagaggaaattccgggattcatgcgtcgttccgtgtcgtttagggaaaataccgatgacggcgtatcgtaaggaaccacggcaggacggtctatgacatacaatccgctcttgttgatcgatcgtccgaatctcgccatgtccgagcccttgccttcctccgcgtccgacgtacacgacctcgtcagcgaactgctgctggggatgcgcctgagcggcgtccagtaccgccgcatccaggtggcgcggccgttcgggctgagtttcggcgatgcgccgggccgcgcgcagttccatttcgtcgggcgcgggcccgtgctgctgcgcgacgcgaacggcgagacgatgcagctcgaagccggcgacgcgatcctgctgccgcacggcggcatgcacgcgctggtctccgaccccgatgcaccgtgccgcgagatcaacggcttcgaggtcgcgaagatctgcgatacggtcgcgtcggtggcatcggcgggcgcgtcgccggcaagctgcgcgacgaccgagccgggtgccggcgacgcgctgatcttcagcgcgtgcatggagctcgatctcggcggcatgcagccgctcgtcggcacgatgcccgagttcatgcatgtcggcacgctgctcgcgcgctacccggaaatccgcccgatgctcgatgcgatggagcgcgaatcctgctcggcgcgcgcgggcttcgccggcatcctcgcgcggctcgcggacgtggtcgcggcgttcatcgtgcgcggctgggtcgaatgcggctgcggcgacgcgacgggctgggtgcaggcgctgcgcgaaccgaagctcggccgcgcgatcgtcgcgctgcatcgcgatccgggccgcaactggagcgtggcggaactcgccaccgaagcgggcgtgtcacgttcggtgttcgccgaacgctttctcgcggccaccgggatgacgcccgtgcgctacctgaccgagctgcggatgcggctcgccgcgcaatggatcacgcgcgaccacgagacgatcgaggccgtcgcgtaccggctcggctacggctcgctcgccgcgttcagccgcgcgttcaagcgcgtggtgggcaagccgccgggcgccgtgcgcgcggacggcgaggcgcgcgtcgaagcgtaaggcgcgacgtgtcacgcacgcgccatgtatcgcgcgtgatgccggccgcggccgccggcagcagccagcggtcgcccgaatcgccgccacgcgtgattgccgcgctcagccgctgcgcgcttccagcctgtcgaccagcgccgtcgcgcactgcacggccagcgccgcgcactgctccgcgtccaccaccgcgccgccggcaacggtgccttgcacgatccggcccagcaattccttcgagagatcggcgatctcgtgatcccgttccgtcatgatgtccctcctgcgcgtcgaccgacggtctccacgcgctcacgtcccctgcccgatcgacgttcagcgccctttcgcccgcacgacgatctgcgcctgcgtgtcgcgctcgatgcgttcgagcgacgcgcgcaacgccgtgaattcatccggcgtacacacctggcggccgaaatccgccgtcatccgccgcgagacctgcacgacatgcgcggccgcgtcgaatacgtaatgcgacgtgaagtcgacgaagcggtcgtgcacggccgtatcggccggcaggtcggtcaccgcgacgtcgtccggcagcgcgatctggccggtctcgtcgaacgtgccgccgatacagccccacggctgcgtgcgcacgggttcggccagccagctctcgacctgcgtcgcgatgccgcccgtcaggctcgacagcgcgggcaacgcggtcgtgccgtcgggccatacgaaatgatcgagcgtgccggaaagcgtcacgtcgaacgacccgtcggtcacgcgccggtcgctggtcgacagttgcgcgcggccgcgcaagccgctttgccgcagacggttgttcgcgagctggacgatggcatcgggtgtcgcgcggcgaaacaggttgcgttcgagttcggccgtccagccgtcatcctcgatgtacgcgtgaaactgcgcggcgcccgccccggccgcatcgatttcgacgcgcgcgaggcggccgcgcggctgcgtggccggcgtgcgcgacagcacgcccgaatcgacgagcagcgcggggcgatccatcacgatgggcggcagatagccgaacgcgatgccggccgtcgtcgtatccgcaaagcgggcgagatcgggcagccacgtgatcgcatgattgatcgccccgccgccgtaaccgggcaccgacggcagcgtgtagacggacccgagattgatcagcaccggttcgctgcggatgccgaccgccgcgagcagcgcaccgaacagcgcgacatgatccttgcagtcgccgtagcggttgcgcaggatgtcggtgacgcgatgcggcgcggcagccgtttcgccgagaaacagcccgacgtagcgcacgttcgcctgcacccagtcgtacaggatgcgcgccttgtcgcgcggatcggcggcgcccgcggtcagcgtgcgcgccagttgcgtcacggccggatcgtccgtgcccggatcgacggccgcgttgcggtagcgcgcagcgaacgccgcatagtcgggcagcgtcgacacgacgagccggtcgccgtaggtcgcgtaaccgaccgcgccgctctcgatgcggtcgtacgggccgtgccggtagtcgaactcgtagcgcgtgcggccgttcgccgtgaccggcggcagcgcgacgtagccgcgcgcatccgcgtacagcggcatgtcggccggcaggtcgaagatcagccgctggttgtcgaccggctcgcgcgacggctccacggtgtagccgaagtagccgcggttgacgggcttcgtgcgggtcttgcggaacgccacgcgtgtgctcgacccggcttcgacgccgggaaacacgacggtgcgcaacagcccgtcctggaacgtcggcgcgccggccgagcgcggttcctgcacgtcgcggatgccgtccacgccgaccggatgcgcgacaccgtcgcggtcgatcgtctcggccgcgagcaggtccaccttctcgagattcttgtcgaaccacacgtagcgctgcgcgacggcatcgatgccgttcgcgttgttcgcgcgcagcgtcgaatcgtcgtgctcgtcgagcgaaccgtcgtgctggatcacgaattcatggacgtcgctgacgagcgtgacgggcgccgtgccggccgtgtcggccgtgtcgtgcggcgcgtcggcggccacgttcgcgcccgggctcgcaccggccgcatgcgatgcgccgagcgaaacagcacatgccaacatccagccggccaggccgacagaaaagcgcaccacatcgcacctcgtcgcggttcggaaaacgcggccgcgcggcgggcaaggtcacgcgcgcggccctcgtgccggccagtgtgggcgacgcatccgcacgcgtcaagccggtgcaggccgacctacaatgagtcatcgatgtgtcatcgcgcgcggccgggaggcaccatggaaagcgcaatcgtggaaggcgtcgtcctgctggcattcgccgcactcgccgcgctgttcttcttcaagcgcccggggcgcgaccgcgcgagagccagattccatcatccgctgctgcggcggccgaaccgtccgcatcggcatcatcggccctgacggccgccaaggggcagtcgccggcggcgcctgccgcgtcgcgcccacgcgggtgtgcaacgcggctgcccgtcccgctggccgacgttcatcggcagcagcaccgtctgcttgccctcgacgtgcagacgcgtctgcaactcgacaggcgtctggttgtgctgcagccaggccgtgaggatattcactcgacggaagatcagcttgctcgcgaagctcgtggagttcggatactcgtcgagcgtcgacgacgcgaggttcatgaattcggcgacggagttcgtgccgaacgcgatccggtagtcggccgcgatgccgcggcgaccgcaatgcgcgacatcgttgccgagcttcggcgatcgcgtgacgcagccgttcgagatgttcgtgcccgtcgtatgccttcgcatcgacctcgccgaccgcgaggaagatcacgttgcggaagtgcccgggaaacatccggtaacccacagcagcacgcgcatgctcgcgccgcgatgcttgccgaccagcagcacgaccggcggttgcgacggatcgggctcgcccgacgctggcgcctcgtcgacttcgggcggcttgcccgagaacagttcgtcctccttggcgagctgcgcgcgcgtagccgcgtagcggcggttgatcgtgaagcacagcgcgatcaccgcactcgtcacgcacagcgaagtcgcgacgcagtagccgccacccgtcggaaacagcgagatcatctggttgtaaccgagcgcgatgatgaacacggtggctgccgtcgcgagtgcgaggaacaacgcgagcggcatgcggtgcgccagcgcgcggaacacctcctccgggccgtagcacgccgacgacaggccgtcggcgccgagcccgccccaggccggcagcggcgtcacggcgatcgcatgccgcgtgcgcggatcgagggggcgagcggcctgccgacgagcaattgccgcaccttccggaaggcggtcatggtcccctcccggaacacccggtgccacgcgctgcgtgacccttcaagactgatcgacgcactggcgcggcgccagtccacatcttccacagggcccccggcggcccggcaccgctttcggcgtgtcaacgaacgacgccggcagccacgcgccggatcgtccacctgcacgcactcgcgcaacacgacgaacctgccccggcgaccttcacggcgatcttgccggccgccttcccgcgccagccggccccacacgtcgtaccgcccgataccggcccgccccgctcgccgccactttccccgcacgccccggcgcgaccggcacctgcgtcctgttcgtgcgttgttccccgcaattcgacttttgtgcgcgcgcaacaatggcgatgcctcgcgcccggcgccctgcggaaacccgtctcccgctcggcaccgggcgcgacggtcttcaaaaccacatctctcgaggacataccatgcaactcaatcccatcccgcgtgccgcccgttttatgaagccggcgaactcacgcaactgactgcctttacgaagaaggacgtaatgtcatgtggatgatgctgcgatcggagccgcggccgtgcttcaaccagcaactcgttaccgacatcatccatctcgcacgcgtcgcacgcgactcgggcctgccgttcgacttctgggtgacgggctcgctcgtccccgagctgttcaacgtcggcggcgacctgagcttcttcgtcgacgcgatccgcagcggcaagcgcgacctgctgatggcctacgcgcgctcgtgcatcgacggcgtgtacgagatctacacgggcttcggcaccggggcgatctcgatcgcgatggtcgagggcagcgcgctcggcggcggcttcgaggccgcgctcgcgcatcactacgtgctcgcgcagaagggcgtgaagctcgggttccccgagatcgcgttcaacctgttcccgggcatgggcggctattcgctcgtcgcgcgcaaggccgatcggggcctcgcggagcgctgatcgcgaccggcgaagcgcacgcatccgagtggtacgaggatcgcggcctgatcgaccagacgttcgacgcgggtgacgcgtatctcgcgacgcgtaccttcatcgacgtgacgaagccgaagctgaacggcgtgcgcgcgatgctgcgcgcacgcgagcgggtgttccagctgtcgcgctccgagctgatggacatcacggaagcatgggtgcatgcggcgttcacgatcgagccgaaggatctcgcgtatatggaacgcctcgtgatgctgcagaaccggcgcgtgtcgaagctgcgcacggtgtagtgcgacgggcgccgcttgcgggcggcgccctttcatgaacggagctcaggcgatcagcctgagctttctcgtctccgcgagccacgcctcgaatgcctgtgccggcatcgggcgcgcgtagtagtagccctgcgcgtgatcgacgtcgagctgcttgaggaattcggcttccgcatgcgtttcgacaccttcggcgatcaccgcgaaattcagcgccttcgcgagcgacacgaccgagcgcaccagcgcctgcgagcgtggattgcggtcgatggccgtgatgaagctgcggtcgagcttgatcgcgtcgagcggcaggcgcgacaactgcgacagcgacgaataaccggtgccgaaatcgtcgagatggatctccgcgccgagctggcggaactggcgcatcagcccgttggccgcatcctcgtcctcgatgaagcagctctcggtcagctcgatgtcgagcaggccgggcttcagccccgcggcgtcgaggatcgacgccatctggtgcacgatgttcatgtcctgcaactgccgcgcggacacgttcaccgcgatccggataccgagccccttcgccttccacgcggcggcctgcgcggccgcggtgcgcatcacccagcgcccgagcggcgcgatcagccccgactcctccgcgaagcgaatgaattcgatcggcgcgacgagcccgcgatcgggcgactgccagcggatcagcgcctcgacgccatgcacgtcgccggtcgcgatatcgacgaccggctggtagtgcagcacgaactgctcctcttcgagcgccttgcgcaggttcgtgtcgagccacatgtacttcgcgaccttctggttcatctccagcgagaacacgcggtacgtatgcttgccctcttccttcgcgacgtacatcgcggtatccgcgctgcggatcagcgtctcgagcgagtcgccgtgctgcggatgcatcgcgatgccgatcgagcagctcgtgtagacctccatcagcccgagatggatcggcgtgcgcagccgctcgagaatgatctgcgcggtcgcttcgagcagcggccgcgtgccgtgctcgaacagcacgaggaattcgtcgccgccgagccgcgcgagcgtcgcgccggacggcaggcagccgctgatgatcgccgacacgtcctgcagcagccggtcgccggtgatgtgcccgtagtgatcgttgacgcgcttgaagttgtcgagatcgaggaacaggatgccgacctgcccgcgcgtcgcggcggtttcggcggcgatcgccgcgtggatgcgctcgctgatcgcgtggcggttcggcagcccggtgagcacgtcggtgttcgcgagttcggtgagccgctgctgcgcgctgcgctcctcggtgatgtcgatgcccgagcagatcaggaactgctcgtcgaccccgctgccgctctggacgaacttgttgcggaactggaacaggcgcggcccgttgaccgtattgatgtagcgctcgaccgcgaacgactggttgctcgcgaaaaagccggtgatgttgctgcgcgactgcgcgccctgctccgggctcatgaacagctcgaacgcgctgcggccgatcacgtcgacctcgcgcttgcccgtcacttcctcgcacaggcggttgaagcgctgcaccatcccgttgcggtcgaggatcacgacgagcgagttcacctccgacacgacctgctcggcgaacgcgagcccgtgcgcgagatcgatcgcgacggactcggcatcggaataggcggaggcggtgccggcccagttggtcgtgtcgaccttccggccgacgagatggagcctgaccggttcgccgaacagcgcgatgtcgagcacgaggtgcgacgtgacgccggtcagcgcgcggatgctcgcggcctgttcggccgtcagcgcgacggcgacgttggtcagcccgcggacggccgccagttcgagtgcattgctgtcgctgccgagacgccagcaggggctgcgcgtaccgacgtgcgcctcgagcaccgcgctatcgttttcgtcatccatggagacgccccgatccagaaaaaacgcacagtgtagacggaggcgagtcggccgaccgcccttccgggccgcgcagcgcgctcccggaagggcaaccgtggttgccgtgatgatgggcctcgtcccgtacttgtttccagctaatgcgacccggcgttcgcgcatgatgcgcgcaggttgtgcctaacgaatgatgagagccatcttatcaaatgacgatcgagaatggcactcacatttagagcggagtgtcaaggaattgggactcgattggcaagccggatttttcatgattggcagcctgcctgaacgcgggtgagacagtgcgcaacgagtctggcacgacgggctgaacgccccgccgggcgggcgtttgcggccgatttcggaataccgggacagcgatgcggcgggatcgtggcgacagggtcggatcgcgttcctgcgatccgatttcccgtatttttgattccgttcgggcattaatgcacggctttattccacagtccgttgcaatgttatccgcgcaccggcgcgggctcccgcgccggtcgcccacgccggtcgcccacgccggtcgcccggctcagcccgccgcgccgtatccgccgccgcccggggtttcgacgacgaacacgtcgcccggcgccatctgcgcacggccgatatgctcgagcgcctcgaccgtgccgtccgcgcgctcgatcgtgttgcggccgagcgcaccggcctcgccgcccgccgcaccgaacggcgcgtggatccggttgttcgacaggatcgacgcggtcatcggctcgaggaagcggatccgccgcaccgcgccgtcgccgccgcgccagcggccgccgccgcccgacccggcgcggatgcggtgcgaatcgagccgcaccgggtagcgccattccagcacctccggatcggtgagccgcgagttcgtcatgtgcgtctgcaccgcgccgacgcccgcgaagccgtcgccggcaccgctgccgcccgcaatcgtctcgtagtactggtagcgatcgttgccgaatgtgaagttattcatcgttccctggctcgacgcgacgcagccgagcgcgccgtacagcgcgttggtgatggccgacgacgtctcgacgttacccgacacgaccgccgccggatactcgggattcagcatcgagcgggccggcacgatcaccgtgagcggcttcaggcagccggcattcagcgggatgtcgtcgccgaccagcgtgcggaacacgtacagcacggcggccatgcacacggccttcggcgcgttgaagttgttgtcgagctgcgcggacgtgcccgtgaaatcgatttccgcgcgccgcgcggcccggtcgacgcgaatcgcgacacgaatctccgcgccgttgtcgagcgggtagcggtacgcgccgtcctgcagcgcgccgatcacgcgccgcaccgcttcttccgcgttgtcctgcacgtgccccatgaacgcgagcacgacgtcgcggccgaactgcgcgaccatccggcgcagctcgtcgacgcccttctggttcgcggcgacctgcgcgcgcaggtcggccatgttctgctcgacgttgcgcgccgggtaacggcccgacgcgagcagcgcgcgggtttccgcatcgcgcagcgtgccggccgacacgagctgccagttgtcgatcagcacgccctcctcgtcgatatgcgtcgaatcgggcggcatcgagcccggcgtcgtgccgccgatgtccgcgtggtggccgcgcgagccgacgtaaaacagcggcgcgtccgaaccgtccgcgaacaccggcgtgatgacggtcacgtccggcaggtgcgtgccgccgtgatacggatcgttcagcatgaacacgtcgccgtcgcgcatgcggccgcggttgcgctcgatcaccgtgcggatgctctcgcccatcgagcccaggtgcaccggcatgtgcggcgcgttcgcgatcaggttgccgtcgccgtcgaagatcgcgcacgagaagtcgagccgctccttgatgttcaccgagtacgcggtgttctgcagccgcagccccatctgctcggcgatcgacatgaacaggttgttgaagatctcgagccgcaccgggtcggcgtcggtgccgagcgagcggcgcgtcggcagcggcgtcgtgcgcgtcagcacgaggttgccctgcgcggtcatctgcgcacgccagccgggctcgacgacggtcgtgccgttcttttccgcgacgatcgccgggccatcgatcgcgtcgccggccagcagcgtgtcgcgcacgtagagcgccgcatcgtgccattggccgccggaataaaagcgcaccgcggaatgcgcgcgcagtgcgccagcgccgccgctgccgtcgccgcgcggcgcgagcgggcgatctccaccggcgcgtcggagcggccgatcgcctcgaccgacgcgagttcggccaccagcggcgtgccgggcatcaggaacgcgtagcgctgccggtacgcggcctcgaacgcctgctgcatcgcggcgacgctgccggccggcacgtcgagcgtcgaatcggtgccctggtagcgcaggtgcacgcggcgctcgatcgcgatccgcgcctgcggcacgccctgttcgagcagcgcgccgacggcctcgtcggccagccggtcgagcgccgcgttcagcgccggcagcgacgcgtcggacaacaccgcctcgaccgcacgctcgcgcatcgcggtctggtcggcgaggcccatcccgtatgcggacagcacgcccgcgagcggatgcgcgaacacctgcgtcatcccgagcgcgtcggccacgccgcacgcatgctggccgcccgcgccgccgaacgtcgtcagcacgtagcgcgacacgtcgtggccgcgctgcaccgagatcttcttgatcgcgttcgccatgctgccgatcgcgatttccaggaaaccttcggcgagcgcctcgggcgtctcgcgccgcccggtcgccgcgtggatctcgtcggcgagcgcggcgaacttcgcgaccacgccgtcgcggtcgagcggttcgtccgcatgcgggccgaacacgcgcgggaaatgatcgggctggatcttgccgagcatcacgttgcagtcggtcaccgtcagcgggccgccgcgccggtacgcggccggccccgggttcgcgccggccgactcgggcccgacgcgcagccgcgcgccgtcgaagccgagcaccgagccgccgccggcggccaccgtatggatgctcatcatcggcgcgcgcatccgcacgccggccacctgcgtctcgaacacgcgctcgaactcgccgtggtagtgcgacacgtcagtcgacgtgccgcccatgtcgaagccgattacgcgctcgaagccggccgcctgcgcggcgcgcaccatcccgacgatgccgccggccgggcccgacaggatcgcgtccttgccctggaacgcgtcggcacgcgtgaggccgccgctgctctgcatgaactgcaggttcacgcccggcatctcgtgcgcgacctgctcgacataacgacgcaggatcggcgacaggtacgcgtcgacgacggtcgtgtcgccgcgcgacaccatcttcatcagcggcgacacctcgtgcgacaccgatacctgcgtgaagccgatccggcgcgccagcgcggccagcgcgcgctcgtgcgcggtgtagcgatagccgtggatcagcacgatcgcgagcgcgcgcacgcccgagtcgtacacgcggcgcagcgacgcttcggcctgctccgcgtcgagcggcacgacgacgtcgccgtgcgcgccgatgcgctcgtcgatctcgacgacggtttcgtacagcgcgtcgggcagcacgatgtcgagatcgaacaggcgcggccggttctggtacgcgatgcgcagcacgtcgcgaaaaccgcgcgtcgtcgcgagcgcggtgcgttcgcccttgcgttcgagcagcgcgttggtcgcgaccgtcgtgcccatcttcaccatgtcgacgcgcgcgggcgtgatcggctcgccggccgcgaggcccagcaggtggcgaatcccggccacggccgcgtcgcgatactgctcggggttctccgacagcagcttgtgcgtgacgagcgtgccgtcgggccggcgcgcgacgatgtcggtgaacgtgccgccgcggtcgatccagaattgccagcgcgcggcgtcggaggaaacgggagtgtcgtgtcggtcagtcatgatgtcgggtcgatgcgtcgtgaaatcgaggacgagcgccaccgcacggcgcgcgcgcgccatgtcacggtgtcgatgaaaggggaggaaaacgcggggcggaccgccccgccggctcaggcggcgtcgagttcgcggccgcgtgtctcgggcagcgtcagcgccgcgacgatcaccacgccgtacgcggcgaccgcgaagatgccgatgctcatgccgagcccgtattgcttggacagcgcgccgatcaggaacgggaacagcgcaccgatcgcgcggcccacgttgtagcagaagccctggccggagccgcgcacgcggtcgggaacagttcggtgaggaatgcgcccatcccggagaagatgcccgatgcgaagaagccgagcgggaaaccgagccacagcatcgacgcgttggtcaggttcagcgacgtgtacgcgaacgcgatcaccatcgagccgagcgcgaacaggatgaagttcggcttgcggccgaggcgatcggtcaggtacgcgctcgtcaggtagccgacccacgagccgaagatgatcatcgccagataaccgccggtgcccatcaccgtgaggtgacgctcggtcttcaggaaggtcggcagccacgtcgtgatcgcgtagtagccgccctgcgcgccggtcgtcagcagcgccgcgcgcagcgtcgtcgtgatcagcttcggcgcgaagatctcggtgaggcgcggcgcgtcggccactttcgcctgcgcggccttctccttctcgtagacgtccggctccttcacgtagcggcggatcgcgacgaccagcagtgccggtgcgagcccgacgaggaacagtgcgcgccacgcctgctcggcgggcagcaccgagaacagcagcgcatacagcagcgcgcacagccccagccgatcgcccagcccgactgcacgaggccgaccgccttgccgcggtcgcgcgcgcggatcacttcgccgatcagcacggcgccggccgtccattcgccgccgaagccgaaacccatcagcgcgcgcgcgcgagcagctgatggtagttctgcgcgagcccgcacaacgcggtgaacacggcgaaccacagcaccgtgagctgcagtgtgcgcacgcggccgatccggtcggacaggatgccggcgatccagccgccggccgccgacgcgagcagcgtgaccgtgccgatgaagcccgcgtccgcgaacgagatgccccaggtcgcgacgagcgtcgggattacgaacgacagcatctgcgtgtccatcccgtcgagcatgtagccgaccttgcagctccagaacgcgcggcgctcgcgcggctgcgcgtcgccgtaccacgagaacaggccgttgcgctcggggctcgcgggctccgcggcgttcgccgcgagggtcttgctttccatggtgatgctcctgtcgtgatgcgccgtcaaacggcggtcgtgcgtgcggtatgtggtgcagtacgtcgttcgaaatgtggtgcgggccgtcgtcgcccggatcagaatacggccagcgacgcgttcgtgatgtcggtcatcagcatgtggccgggcgtgtgcgcgatcgcgatcggcagcttcgcgtccatcagcgccgtttgcggcgtcacgccgcacgcccagaacaccggcagctcgccgtcgcggatcgtcaccgcgtcgccgaattcgggcgcgttcaggtcggcgatgcccagttcgcgcggatcgccgagatggatcggcgcgccgtgcacgcccggaaaccggctcgtgacctgcaccgcgcggatcgcgtcggcgccgcgcatcggccgcatcgacacgacgagctggccgccgaagatccccgcccggcggttcgggatcgacgtgcggtacatcggcacgttgcgcccctcctcgacgtggcgcaggccgatcccttcgcgtgccagcatgtcctcgaacgagaacgagcagccgatcgcgaacacgacgaaatcgtcgcgccacagcgcgtccagcgactcgacgcgctcggtcaggcggccgtcgcggtagacgttgtagctcggcacgtcggtgcggatgtcgagatcctcgccgagcgcgtcgacccggaacgcgcccggttcgccgacgcccagcagcgggcaggctttcggattcgcctgacagaagcgcaggaaatcgtgcgcgtacgcatcgggcaggatcgcgaggttcgcttgcgcgtacggaccgcaatggcccgcggtcgggccgcggaatgcgccgctgcgcacggactggcggaattcggaaggcgtcatgaggttctgtcgcttgtcggtgtgtcgtcgggatgacggtgccgtgtcatcggatacggcgaagaatagaaaagaaaaattttgtcgccaacgagtttttgcgcttcgtgtatagaatttctttacacgaagccgggttttcccagtcccgttcatttttcagcgggacaagctgcgcgcccaacgccttgccgaccaccatgaacacgcgttttctcgaaaccttcgtcacgctcgcgaagctgcgcaacttccgcacgacggccgccgcgctgcacgcgacgccggccgcgatctcgcagcgcctgaaggcgctcgaggacgaattgcagacggtactcgtcgaccgcgacagccgcgagttccggctcacgccgaacggcgaatatctgctcggctacgcgaaagccgtggtcgaggcgacgcaggaactgcaggccgccgcgtccggcgaaagtgcattgcgcgggaagctgcggctcggcgtgatcgagaccgtcgtgcacagctggctgccgcactacatgcggcggctggcggccgactatccacagctggaaatcgacctgaccgtcgacgtcagcgtcgtgctgcagcgccggctgatggccggcgagctcgacctgatcatccgcgtggaaggcagcgacgaagcgtcggtcgtgtgcgatgcgctcgcgaactatccggtgcgctggatcgcgcgggcggggctgctgccgaatacgcgctcgggcctcgcgcggcaggtgctgcgccagccgattctcacgtacgggcgcggtacggcgccccaccgtgcgctcgaggatatcgtccgtacccttgcgcatgcgcacggcgtgccgctgtctgacacgcgcatcaccgggtcgccttccatctccgtgatcgttcaactcgtgcgcgacggtttcggcgtcgcggcgattccggtgctgttcgtcgatgcgctgatcgagagcggcgaagtcgtcgagctgccgctgcagccgtcaccgccgtcgatcgtcgtgtcgatgtcgcggcgggcggatgcgccgaggttcgtgcacggcgcgtcgattgcggcgcgggtcgcgtgtcacgagtattgcgagaagagtacgcggcggttggttgaagcgctttgaggcgtggggcgcgcaaggcggcattttcgggttcctgagcgggtatctcgcttgtgaccaggacgggggcgggtcagtggccccttagaccgtgggtaggaggatagctgccgtcgagagacagacgcagcccggtttccgacttcgagctgaaactcgtcaccatctggtcgtgcgcgaaacctttctgcaggctgttcggcacttcgggcgtgccgcgttgcccgacacgttgtcgtacacgctgcggctgaagaccaggaagcccggcacgaaacccggcgcaaaacggctgtcgccgtcgttgtcgtgcgggcggcctgcgcgccgatgcgcgcggcaatcggcgtcagtgcgacaacgggaacggtacgatcgcacagcgtgcggcgacgcttcgcgagcaaggcgacattcggcatggacaaggctccgaacgacatcgagtgaggaccttgttggtggacagactgacgacgtgaagtcccgccaccctagagcctgttgacaatatcaagcaaacgaaatcaaggatcggggaagcacgcgcggtagggatatccattactgcgccttgagttgcggcaggccctagagcgcgtgaccgtcgagaaaggcaaattatggccagaggctacccttctcgcctaacccacgtgcagccaggcggacctcggcgtcgtcgttccatttcatgctgcccgaaaacaggctgacagaacgagtagccggagaccaatcccggtcacgcaatgcattcaggtcaagcgccacgcccgaagcgcgaaactcccgcaaccggtcctgcacgtctagcccgggtaattcggccaggttccggcaattgaacagcgacagccgttccaacttcgcgccgcacaggtccagcctcgaaagctgcaactggtcctcgatgcgcagggcagaaagcgagggcaagcgtgataggtcgcccaacgtggaaagcccgcgcacgcgcaggatttgcagcatctcgatggttgtactagacaagtcgtcgatgtcatcgcgaccgcccaggatcagcgtcatttccctcaagtccgagatggccgagatgaagccgagcggatgctttttgcataggaactgagcgtcagcttgcgcaggcgggataggcctgcgatcgcgtcgatatcctttgaatggccttgaatgaatagttcggtcagcgatccgcaccgcgctagaggcgacagatcgatattccgcttatggttttcagccagcacaagccgctcaagtcggccaatgtcgatcgtgtcgaggaaatcgggccgattcagcttgaaaaccccgaagctcaggcgtttcagctttggaagcaggccgacttcttcttcatggacgatctcggaaaggcaatcgactgcaaggtcgcgtgtttcgggcaaatggcgcagcaaggccgcatcgaacggcgcccggtagtgcccgtagaaccggacctgaaggcggtccccggctagccggcaagcttcgttcagcgattgcaggatcaccgggttgtaggcttcgggcgtgctgaactggacaaccaactgcccgtgctctccgcaggcctccacgatctcgatcggcgaaagcgttttcgggtcggtaacccggccacggtctacctgcagcatgcactccccgttattcgttaatggcctcgtcattagacggctacgggccacatcttagcgcctcctgaagcctacttaatattccgaactctggtggcacctactcagcgtcgcgcgttatccgacagtgatttaaacaagccatatgaacgaagcggctgcaacaacgaaggacgcgtagcgctgggacaatttatcgtatcgggtagctacgcgacggaactgtttgattcgagcaaagaaccgttcgaccagattgcgggagcgatagagatgtctgtccaatggacgctgttcacgcctgttcgtgcggcttggaatgacggcctgcgcgccaattgcgtgcagatgcgtaatgagggcgtccgtgtcataggccgtgtcggcggcaacgctgccgggcttgaattcgcccagcagcggtagtgcctcggggctgtcgcctgcctgaccaccggtgaggctgaatttcgccagcatgcccaacccgtcaaccaacgcgtgaatttttgtgctcaggccacacgagagcggcctagcgcctggtcacgtttttgggtgcgccagcggcgtgctggtgtgtacggacaatggtgctgtcgatgaagacctcctcgaaatccgcatcgccggccagtgcggcaaacaccccgtgccaaatgccggccagggaccagcgcgggaatcgcttgtatatgctgttccagcgcccgaattcttctgggaggtcgcgccacaggctgcctgtgcgggcaatccacaaaacagcctcgacaaattcccggttgtcggttgccggtcggcctcggcctcccgccttgccgggcagcaactgcgcaatgcgttcgtattggtcacctcgcaacagcctcggcaccattcccgcctcgcaaaagacaggatgtaatcagattgccgttgaaggtgacagcgccggacgtcgtctcgctgctttttgtcaacagccctagccatgcttgacgaagaatttgcacgcgttaccgcgaaaacccgcgtcccaacacgggcttccgggcgcggcgcgccgttacttatctgcaatgcgaaataaatgattcagacagccattcacgcggattgccctgcatgcggctgcgtcagcttgccgtcgccgtactcgcgcagcaccttcgaaatcacgacgcgatagccgtccagccaacgcgcctgcttcgcctttgcctcgcgatgcgccggatgctgcatcaactgctgcagcgccgcctccgattcccagtagtagacgttctggatcagccccgattcggcgttttcccacgtctcctcgccgagatagccgggcgtcgcgcgcgccatgtcggcgatctgccggtcgagccgatggaattcgtcgtcgtattgcccggcgcgaaaaatgaaggtcgacgcgtacatgccagctccatcgaaagcgattgaaagagcggcgattgtaaggcacgcgcggcgtgccgcgatcgtcacgcggctagcggatcggcaccggcccggccggcaagccatgcgtcgatgcgcggcgcgtcttcacgcatgccggccgcgggcgccggcatcgcggccaacgcgtgccgtgcacgttcgagcgcctcccgaagccgcgcaactcacgcgtcgccgggcgatcgccggcatggcggcgtgcgagtgccgcttcgatgttcgcggcgatcaatgcacgctgagcgtcgatgaagtcgatgcacagcgtgcggcaatgcgcggataccgacgcaacggcgagcaggacgggcacgatcgacacggtcaggtacccaccgggcgcgagccgcgacagcgcacgatgtccctcctgcccgccgccggtcaacgatgcgaacaccgcgtcgcgccacaccgcgcgctcgaacacgagcgcatcgcgatacgcatcgagcgccgcacggtctgcgacctgtccggccgtcaccagcggaatcgggaaagaggattcgacgggagactgcgcgcccgcggtgtcgacaatgcagttcgcaccaagccatcccgcatcgtcgcgccgcgcggccagcactcgggactgcaaccggtcgggcagcatcggatcgagcggcaccgcgccgcagatcgacggcttgtccgcatgcacgctgcagcggccgtcgtcggccagtgccgcgcaacggccgagcgacggataatcgtagccctgcagcgtcaccgcgatccattcgctccccgcgatgccggtgcgatgaaacagttgcccggccagcgcatcggaagccgcgacatcgtcggcatcgagcgcgtattcacggccgcccgcgcgccagcgctcgccgatccgccgcttcggcacgcgacggatcgtcagcgcaccgacgaagcgatgacgatgccggaacagttcgcgcaacgacagcgtcggcgcactgttgcagcagcgtccgcatgcgttgcacgcgagcaggtaggtgtctaccacggccgtcgcaccgaatcctggtagcgcgtgagaatgaagcgcgcgacgtcgtccgagtgataggcggcgacgagttgcgtcacccacggcttcgcgcgatctgcgtcgcgcaccgtcagcacgttcgcatacggcgagcgcgcgtcctcgaggctgatgctgtcgcgcgcgggttgcagcccggcacgcgcagcatcgtcgctgtcgattgcaacgaacgcggccttgtcgagcgccgcgtaaaggcgttcgcggcgcagcgcgacgagcttcagcccgagccggttgccggtcacgtcgcgcagcgtcgcatgcaggccggcctgctcgcgcagcgtcaccagcgtgtcgttctgcagcagcacgagcgcgcgcgccatcccgcgcggatcgtcgggaatcgcgaccgtcgcaccgggttgcagttcgttcaggttcttgagcttgcgcgaatacagcgccatcggcagcgtgacggtcggcgcaattccggtcagggcgtagcgcttccgcgcgcgcgtcgcggcaagctgttgcgcgtcctcgaagctggccgcgtcgatccggccatcggccagcgccgcgtcgatgcgcgacgcatcgtcgaattcgacgacgtcgatgccgaatcctcgtgacgccgcgacccgcttcacttcgtcgaggatctgcgcatgcacgccgcgcgtcacgccgacgcggacggccgctgcagtcgctgcagtcgccgcagtcgattcagcggcgacggccaaagccggatgaacggccccgcacgcaaccatcagccacgcgcccaggtagtgcacgacgcgcttcatgacgcatccctcagaatcgtgcgaaatccgatatgcgacgcgccgagatcggcttcctgctgttcacgcgacgacgcgcgatagcgcacgcagtagtcacgcgagcacaggaacgagccgcccttgatgaccatcggcgtatcgtgccggcgcgtcggcggcgcgacggccgccgtgtcgccgttggtatgcgactggtgcgggcccgtgtacgcgtcccgggtccactcccacgcattgccgatcatgtcgtagagccggaacccgttcgccgcgtagcagccgacgggcgcgagccccgcatggccatcctcggccgtgtcgagcaccgggaacgcgccctgccagtagttcgcggccggcttgccctgcgcgtcgcgcggcgccgcgtcgagcgacgcgtcgtcgcggccggccttgcccgcgtattcccattcggcctcggtcggcaggtcgcggccgagccaccgcgcatacgcgagcgcatcgcgctgcgtgacgagcgtgacgggcaggttgccgatcccgtcgacgccgctgcccggcccgcgcggatgacgccacgacgcgcccttcacccacgaccaccacgcgaggtcgcgcgcgttcatctcgtcgcgtgtcggcacatggaacacggccgccccgccctgctgctcggcctcggtaacgtagccggtcgcctgcacgaacgcggcgaactgcgcgatcgtcacgtcggtctggtcgatccagaacccgccgacgcgcgtgcggccgtcgcccaccgggcgctcgtccgcgtagccgcgcgtgctgccgaacacgaacgcgccgccgcgcaggtgcaccatcccggccttcgggtcgtcgcgccacccggccggcagccccgaatagcgcgcgcactgccgctccgagccgagcggcgcgagtgcgcggccgcgattcgcgtcgtcgaatgcgtcgcccccggcgcgacgggattcgcatagccggccgcgaacgcggcggcgaacaacgtggcagccagcgccgcgccgatcgtccagaaccggaaccgcatcgtgtcgccccggtatcagtagtagccgcgcggacgcagcggttcgacaccgccgacgttgctcatgtaggtcttccactggtcgacgagcgtgccgatcaccgacgggttctgcgccgacacgtcggtcgtctcgccgcgatccgacgcgaggtcgtaaagctgccagtgcccgtcgagcggcccgagcggcggttcggtccacaatgccttccagcggccgtcggcgctgcgcaggtaggcgcggccgtatgcttcgtcgccgaacggcgtcgtatgcacctcgcccgtcgccgaccccgtgagcaccggcagcagcgactggccggtgaccggatacacgtagcggttgttgtagatcaccttgcccttgttctggtcgacgcccgtcagcgtgttgacgagcggcggcgccggctgcgacggcggcgtgacgcccgcgatcgcgaggaacgtcgccgtgttgtcggtcacgtgcgtgaacgcgcgcagcgtcggcaactgctgcgtctggcccggcaggcgcacgatcgtcggcgtcgatacgccgccttcggccgaatacccttcgtgagccggaacggcgacgcgctcacctcggcccagcgcagcccgtactgcaggcgctgcgcgttctgcttgccgttgtcggtgccgagggtcgagtagaccggctcctgcccgttcgcggtgtcggtcgccgtcgggtccgcgcccgagtcgatcggccagccttccgagccgttgtccgactggaacatgatgaacgtgttgtcgtattcgccgatgtccttcaggtgctggatcaggagtccgatgttgtagtcgaggttctcgaccatccccgcatagatctccatgtagcgcgcctgcgcccgccgctcggccggcgacaggctcgaccacagcttgtcgaccttgccggggccgtagtcgctgtagccgtcggcggccgaatgcaccgcgctgacgtatttcgcgttcgcggtgccgttgttcgcggtcgcgggcgacgccgccgtcgtttcgggcaggccgtcgaacggcttgaaatcggcggggatcaggccgagcgccttctgccgtgcgatccgcgcattgcggatcgcgtcgtagccggcgtcgtacacgcccgcgtacttgtgcagccatggttcgggcacctgcagcggccagtgcggcgacgtatcgccgcgtacgcgaagaacggcttgccgtcgcgcttgttcgaatcgatgtacgagatcagcttctgcgtatagaaatcggtcgaatagaacacggccgggctgccgcccgcgccgcccggctgcccgggctggccaggctgcacgtaacggccgtcttccgtgtagttcgacgagccggccggctcgtgcgcgaagtggttggtcgccgcgccgccgagcagcacgtagctgcgctcgaagccccactggtccggcgtctgcccgctgcccgtcgcgctgccgacgatccccgagccgatatgccacttgcccgcgatgtacgtgtggtagccggcatccttcaacagttgtgcgaacgacagcgcgcgatcgttcaggtagccctcgtagccgggcagcccgcgccgttcgtcggtcggcaccccatcgtgccttctccgaccagatggtgatcggtgccggacaccagcatcgcgcgcgtgatcgcgcagacggtgcccgtgtgatggttcgacaggatgcggcccgacgcgacgagcgcgtcgaggttcggcgtgttgatctcgccgccgaatgcatggatgtcggaatagccgagatcgtcggccatgatgtacaggatgttcgggcgtttcgccgccagcggcggcgcggggttcgtcgatgacgacggcgcatcgctgtcgacgccgccgcacgatgcgagcgacaacgcgccggcaatcgcggcgcagacgacacggaaacgaaaagcatgcaacggcgaagcggacttttcatcgttctggaacgcgcgatctacgggatcggcgatcttagcgtcgcgcgcgcggcacccaaagtccgattcgtcacatgctaacggggcggcggaatatgcgcgcaagccgaataccggccatcagcacgcgcgtatgcatgcgcgcgcgccgcgcgccgaagccggccgccgccgggccgcgcgcgacggctcgcccgcgcgtcgtgcttcagctgcgtccgccgaggctgccgccgccgtccacggccagcacctgccccgtgacgaagccggcctcgtccgacaggaagaacgcgatcgcggccgccacatcgtcgggcgtgccgagccggcgcgcgggaatcgtcgcgagcaccttgcgttcggcttcgctgccgacggggcgcgtcagccggaacagttccgtctcgatcggccccggcgccaccgcgttgacggtcacgccatgttcggccagttcgagcgcccacgtgcgcgtgcagccgacaagcgcgctcttcgcggcggaatacgcggtgcggtcgagactgccgaaaatcgcccggctgcagatgttgacgatgcgcccgtggccgcgcgccttcatcgcgtccgcaaagtgctgcgtgacctggatcgcggcccgcacgttgagatcgaacacggtctgcagcgaccggaaatcgatctgcccgagcggttgcggcatcacgatgcccgcattgttcacgataccgtcgacagcgtgctcctcaccgatacgggcaagcgtcgccgccgtctgttcgatgtcggcgagatcgcacgcgcgcagttcgccgggaaagtcgatgccctgcacatttcgcgcgaggccgatgacgtgatgaccgtgccgtgcgagcaaggtgctgaccgcaaggccgatgccgcgcgatgcgccggtgacgagataggtgcgagatgacatgcgtgctcccgaagttcgttcacgtgaatagcgtggagagaggtttccagggtggagacccggaaccggtgctttggtcggacgattctacgtgcgtaacggacgttacgtcgtgtcgttacgggcgtgtccgtggcaacacggtacgtttactgcgcatgaggtgcgtcaggaatttccaaatcacgactggtgggaattatcgtctgatttaatcttgatgcgccgaacataaaagaaagcttgttaatcaaatatcgaacccgcaaacgttttacgcgaatgaattacgcatccgaaaaattagattaataacgactttaaaacagattccgcttgaaacgacaacaggcacgcctcttgctgactcctttcaccatgtgctgcgttcggcaaggaacgaataacccgaaaatcgggcgccgccatatttcgcacaagtgaatccgggctacgtgacgcagaccggctacaacaacaacgccacgctggtacaacaaggcacgccaactacgcgaacatcaatcagaacggcttcaacaacaccgtttcggtcgagcagcactaaacgccgccggcgtaacggaaaggccggacggatacacgttcggcctttttcattcgacaggggacgatcatggtcggcattcacgatctcagcgcctatttcgacatcgccgccagtgccggcggcgtgaatatcgtgccgcacgtgcgggcggctgcaccggtcgacgtgtcgtacagcctgcgcatcacccgaaccggcggcgcgggctcggcctcgctgacgcgctccggcgaatcgcggctcgctggcggcgaggaccagccgctcgcgacgctgctgctgagcgtcgattcgagcgatatctgcaaggcaacgctggttctgcacgtcaacggcgagcatgcggagtattcggtggactgcaatccgcatcggacggcgggttgatacggcgcggcctgggggccgtcgcgccgcatggcaagcgcctgccgcgcggcgcgaccggcatcggcacgcgcggcggtcagccggcccgcccctccgccatcggcatcgcgcaccgcgacgcgatccgccacgcacgaatcggccggcatcgacacgccggcccgcatcccgcgcgcgttcggtattcagtaacgcatcacgagaaacaggccggcagccgcgagcgccatccccggccatgcgagcgcgccgatcgtctcgccgagcgccacgagcgcgatcagcgcggtcgcgggcgggatcaggaagaacagcgccgacacgcgcgacgcctcgccgtaccgcaccatcgcgagcagcagcgagatcgcgatcagcgagttgcagatgacgaggtacgcgagcgaaccggcgagcccggcggtccattgcacgtgcatcggttcgagcgcgaacgcgagcggcgcggtgaccgcgaggccgaccgcgtactgcacgaggttcgcggtgaccggatggacgtcggtgccgaagcgcttttcccacagcgtgccgccggtgatgcaggcgagcgcgaacagcgcgaacgcgagcgcccacggcgacgcgacatcgaccgacgaacgcgcgaggatcaccagcaccgcgcccgcggcaccgagtgcgagcccgatccagcgcagcacgccgacgcgttcgccggcaatcatcggcgcgagcagcccgacgaggatcggctgctgcgacgtgacgagcgcgacggcgcccgccgacatgccgagcttcaggctcaggtacgtacacgcgaaataaccggcctgcagcaacaggccgaccacgacgagatcgcgccatgcgcgcccgtgcgcggcaacgcagggcgcagccacaggaacgggccggcgagcagcgcgacgacgcacgcatagcgcagcgcgaggaaggtgagcggatcggcataacgcaagccgagcttcaggaacacgaagccgcttgcccacagcagcaggaacagtgcgggcgcgatgcgcagccagccgggttgccgcgcggccttcgtggtatcgatcgtcgtcatgtacgcgcgcgccgggttgtcgcagggaggtctgccccgtgcgcaccggggctgcatgccggcccgcgcatcaccgaagaaccgtgtaacgggtgaggttcggaacggtcgctgcgatagcgatgacgatggcgatctgcggttcgcgcttcatcacgtcgtgcccccggcggattgggtgtgcgacgatcatacgccgcaccggccgaccatgcgccgcggggatgccgcgaccgacgcgcccgcctcacccatccgacgcgagcatcttcggtatctcgtcgacgagcgcatcgatgacgacacgcaccttcgacggcacgtggcgcgatgccggccgcacggcgaacacttcggcgcccgacacgctgttgctgtccatcacgagcgcgaggcggccgtcgcgcaggtaaggcgccatcagccagcaggggagccacgcgaggcccgcgccggcggcggccgcatcggcaatggcctgcaggtcgtcgagccgcaggcgcccggccggacgatggtcgtgcaccgcgccgttcgcgccgactatcggccacggcgtcggctgcccgccgcgcgaatacgcgatgccgacgtgcgacgcgagttcgtcgagccccgccggccggccatgacgttcgagatacgcgggcgatgcgcagatgcccatgcgctgcacgccgagcttgcggccgacgagcgcgctcgtatcggcgagctcgccgatgcgcaccgcgatgtcgaagccgtcgttgaccaggtcggccacgcgatcgctgaacgacacgtcgatttcgagccgcggatggcgctccacgaggcgccgcatgagggcgccacgcattgccgcccgaacagcaccggcacgctgacgcgcagccgccccgccggctcgcgctggcccgcgtcgagcgcggcctccgtctcgccgagttcggcgagcagccgccggcactgttcgtaatagacgagcccctcgtcggtcaggccgagctggcgtgtcgtgcgctgcaacagccgggtgccgagacggcgttcgagccgcgcgacgaccttcgcgaccgccgagcgcgtaacgccgagccgcagcgcggccgccgcgaagctgcccgaatccaccacgtcgacaaattcggcaacgcctctcagccgctcgtccatgccatttcgctccggtcgggtaacaggtttgtgtccatgcaggcgacagtcatcggccgaattatcgtcaatgcgtccctgcgcgcaacactatgatagtccgcactatctcgaaaaaggagtcgacatgcacgcatggcaagtgaaaccgggcgacggtgcggccgggcttcggcgcatcgacgcgacacgccgcgcggtcgggccgaccgacgtcgtcgtgaagatccattcggccggcctgaactatcgcgacctgatgttcgcgcgcggcgactatctcggcatcggcacggaagcgctgattccggttgccgacggcgccggcgaagtcatcgaaacgggccgcgacgtcacgcgcttcaagcccggcgatcgcgtgatcaacacctacttcccgcgctggatcgacgggccgccgacgccgcagaaaacctcgggatcgcccggctcgcatttcgacggcgtgctggccgagcacttcgtgtccgacgaagcggcgctggtcgcgattcccgagcatctggactacgacgaggcggcgacgctgtcgtgcgcgggcatcaccgcatggaacgcgctgttcgccgacggcggcctggggcccggcgcgaccgtcgtgctgctcggcacgggcggcgtgtcgatcatcgcgctgcagctcgcgcatgccgcggggctgcgcaccatcgtcacgtcgtcgagcgacgcgaagctcgaacgcgcccgcgcgctcggtgcggacgcaaccatcaactatcgcgccacgcccgaatggcaacacgacgtgctgcggctcaccggcggcgcgggtgcggatctggtcgtcgaagtcggcggcaaggatacgctgccgcgctcggtcgcggcgacgaagatgggcggcaccgtgtcggtgatcggcggcctcagcagcttcggcggccccgagctcgggctgctgtcgctgatcggcgggatccggcggctgcaggggatcatggtcggcagccgcgcgatgctcgacgacgtcgtgcgcctcgtcgacgcgaagcggatcaagccggtggtcgatcgcgtgttcggcttcgacgaagcgccgcaggcgtatgcgtacctgcagtcggggcagcacttcggcaaggtcgtgatccgcgtcgcgcagtaagcgcatcggggcgatgggcagcgggcggcctcgcccgctgcatccggcgtcagaacctgtgacggatccccgcgtgaatcatcagctgcttcgaggtcgacgacaggtccgccgcgccgggaacataggcctggtcgagcgacgaacccgtcgcgtcgcccgcgatccgctggtaggcgcccatcaggtacacgtccgtgcgcttcgacagcatgtagtcggccatcagccccagcgaatgaatcttcggcttcgcggtgcccgtcgtcgcgtcgtagcgcaccgtcgtgtacacgtactgcgccccgacgaacagcgcgggcgtgaactggtatttgccgttcacttcgaagttctggtacttgatcgacgtcaccgtgccgcctgcgagcgggccggtcacgggctcgatcgtttcgtcgccgaacaggtaaccgacgttcgcggtcggccgcgtgacgttgctgttcgtgtacgcgaacccgaccgtcgcgggccccgccgtgtagttgatgcccgcaccgaagatccgcagccgcgccgacgcgaagttcgcatcggcgccgaccgatcccgagcccgcgatcgcgccgcccggcgtcgcacccaggttgtccgcattcaggaaggccgcgccgacgagccacccgccctgctcgtactgcgcgccgacgctccactgccggttgttcgcgaagcccgtgtcgttactgaagctgtacgtgccgccgaacgagaagccggcgaaatccgggctcgcatacttgaccgtgttgttgacccgaaacgtattgccggtgttgtcgttgtcgagcggatgcgagaacggatagacgccccaactgccgttcgcggtggtcggcgcgagatagtcgaccaccgcatcgtattgccggccgagcgtcagcgtgccgaaccgcgcgctgccgaggccgacgtacgcctgccgcccgaacatgcggccgccctgcgcgagcgtgccgctgttcacgttgaagccgttctcgacctggaacagcgcgctatagccgcccccagatcctcgctgcccttcagccccagcggctgccctgcgcgaagccgctcgccatctgccacgcgccatggccgccgacattgttcgtgtagtcgatgcccgcatcgacgaggccgtacagcgtgacgctgccttgcgcgaacgcgggcgcggcgcacagtgccggcatcgcgacgaaaatcagtctccagttcatccgtcatccttatttatcgtgtcgttaccgcgccatgcatggcgccaccgcttacttcgtgccgtagatgtcgaagtcgaaatacttccggttgatccgctggtacgtgccgttcgcgaggatcgtcgcgagcgcgcggttgaaggcgtcgcgcaggtcgttgtcctgcttgcgcagcccgagcccgtcgccctgcccgaaatacttcgcgtcgtcgatcgccgcgccgacgaacgcgaaatccttgccctgcggcttcttcaggaaaccgtcgctcgccgcgatcgatgcctggaacgccgcgtcgagccggcccgtcacgagatcggcatagacctggtcctggttcgggtacgacacgatctgcacgccggccggctgccagttcgcgatcgcatagtcggcctgcgcggagccctgctcgacgcccacacgcttgcccttcagcgcgtcggccgtcggcagcagcggcgaacccttgcgcgcgacgaggcgcgccggcgcattcgagatccggttcgtgaaggcgatctgctgctgccgcttcggcgtaatcgtcatcgacgacgcgatgacgtcgaacttgcgcgcgagcagcccggaatcatcccgtcgaaactcgactcgacccacacgcagcgcgcatgcagctccgcacacaacgcattcgtgatgtcgatcccgaagcccgtcagcgtaccgtcgggcagcttgtactcgagcggcgggtaagtcggatcgaccgcgaggcgaatctccctgcccgcccagtcacccgcatgtgccgcccccgccgccagcgccaacgcgagcgccgccatccgtttacattgcttccactgcttcattgccagtctccttcctcgtgtgaatcgtcagtcaaaatcatgcgggcacgtcacgcgagatagcgctccgccaacgcaatccagtagctcgcgccggtggcgaggcacgcgtcgttgaagtcgtagccgggatggtgcagcccgcatccggcgccgccgtcgccttcgccgttgccgtccccgttgccgatcgacaggtagctgccggggcaaatgttcagcatgaacgcgaagtcctcgcttgccgcgatcggtcgcagatggggatcagcgcgccgtcaccgccccattcgcgggcgacgtcgcgcgcgaaggcggtttccgccgcgtgattgacgagcaccggatagtcgtggcggtaatcgatctcggccgtcgcgccgtagctcgcggcctgcccgtgcacgatctcgcgaatgcgccgttcgagcagcgcgcgcacgtccggcgacagtgcgcgcacgctcagtgccagatccgcgtgcggcgggatcacgttcgacgcggtgcccgcatggatcgagccggtcgtcacgatcgccaggtcctgcgggttcacgttgcgcgacacgacggtctgcagcgccatcacgatcgacgcgcagacgaccaccggatcgatcgtcgtatgcggcgccgcgccatgcccgccgcgcccggtcacgcgcacgcgcacctcgtcggccgatgccatcgccgggccgtcgcagaaacccagcacgccggccggcaggctggcacgttgtgcatcgcgaacaccgcatcgcacggaaactgctcgaacagcccgtcgtcgatcatccgcttcgcgccgccgagcccttcctcggccggctggaaaatcaggttcagcgtgcccgtgaagcgggcgcgctcggccaggcaccgcgccgccgccagcagcatcgccgtatggccgtcgtggccgcatgcatgcatcacgccgtcgcaccggctcgcatgcggcagcccggtcgcctcgtggatcggcagcgcgtccatgtcggcgcgcagcccgagccgcttaccggcgcctcgcgtcaacgtgccgaccacgcccgtgccgccgagcccgcgcgtcacccgataaccccacgttgtcaggaaaccggccacgaggtcgctcgtcgcatgttcctcgaagccgagctccggatgcgcgtgcagccgtcggcgcagcgcaatcatctccgtctcgatggccgccaattccggctggactggtttgtggttcaaccccgattctcctcgatgtacgccggttgccgatcgcccgaatgaccgatcgtggccgcatcgtaggcagcgaaaatcccggcgaacagccgcggtttcgttatgatgacaacctttcgttgtcgagtatcgcaccatgggtacgatcaggctgcatcagcttcaggcgctcgtcgcgagcgcggaggccgggagcatccgcggcgcggcgcgcacgctcgggctgtcgcaggcggccgtcacgcgcgctgcgcgaactggaggccggcgagcgcctgccgctgctcgtgcgcgcgccggagggaatcggcttcacggaatacggcaagacgctgctcacgcacgcgaagctcgtgctgaagcagctcgaacacgcgcagagcgatctcgagcgcatgcgcggccgcatcgagggccggctgagcatcggcgtgacgccgtggctcacgatgacgttcctggcggaaacggtgctgcgctttcgcgagcggatgcccgacgtgcgcctcgaactctacgaggcgctgatggccgtcgcgcagccgctgttgcgcgacggcagcatggatttcgcgctcgggcacgtgcaaccgggcggcacgcaggaattcgcgttcgagccgatgctgcgctacgacacatcggtgatggtgcgcgccggccatccgcgcgaacacgcgcgatcgatccatgacctgctcgagaacgactgggtgctgaatttcgcggccgacgggcaggccgcgctcgtcgactacctgttcacgcgccacggtgccgacatcgacgaacggcgcatcgtccgcgcgcagtcggtggcgatgctgcagacgatgctcgaacaggccgacatgtgcacgtggtgcccgacgattctcgctgccgtgccgccgttcggcgaacggatgcgcgcgttgcagctgaaggagactttcgagccgcgcgacctcgggatcgtcacgcggcgcagcagcacgctgagcgacgcggcgcgctgcttcatcgagtgcctgctgcacgtgatccgccggcacgcgcgatcggcacgcaaggcggatctcgcgctgttcaggacgctgtcgctgctgatctgacgcgcggcgaacacgggcgggccgccgcgtcgccgcatgcgcgtcgtggccgtgcccgtgcccgtgccgcccgtcagattttcgcggtcagcgtgatcccgaccgtgcgcggatcgccgtacagcaccggatacgcgccatacgacggcagcagctcgagcttcttgtagaccttgttggtcaggttcgtcacgtagcccgtcacgatgtacttctggttcggcgtcgtgtaggaaacgtgcgcgttcagcaccgtgtagccgccctgccagagctgcggcatcgtctgccgggtcgcgctgaagtattcgcggctgcggtagttcacgtcaccgccggccgtcagcgtgccgaacgacaccggtacgcgatagtcgaagcccgcattgatcgtcgtatgcggcgagcgcgcgaacgagttgccgacggcggtcggcacgtagcggaactccgtgtagcgcgtgttcagcatcccgaggttcgcgaacaggtagaggctgttgaccggctgcgccttcagctccagttcgaagccgtccgcgcgcccctgccccgcattcgacagcgtcgacaccggcgggccgccgaacgggttcggcgcgagcgcgaacacctggatgtcgcgatagtcgtagtggaacacgctcgcgttgacgatcagccgcttgtcgaaccactcgctcttgatgccgacttcatagtcggtcaggtactccggcgacacggtcgacaccgtgctctgcgtatacgcgttgccgttgtagccgcccgaacggaagccgcgcgcatagcggaagtacgcacgcacgttgctgctgagcgcgtattcgggcgtgaggtcccaggtcggcgcgcgccaggtgttcgtctggttctgccgcgcgctgaccgccagcggcgacgacaccgacgacggctcccaccagctgccgggattgtcgaacgtcacgttgccggtgccctgcagcccggtcaggttgatgttcttgcgctcgatcgtgtaacgcagcccgcccgtcacgttgaagcggtcggtaaaccggtacttcacgctgccgaagatcgccgcgctctgcgtgtgctgcgtgaggtcggtcaggtggtagaacgcgggtgacggcgaacccggcaagccgccgccggcaccctgctcggccagctgctcggtgaacaggtgggtgccgacgagccagctcagccgatcgttctgcggcgattcgagccggaattcctgcgagaactggcggctcgacaggcgatcgtgcgagcgtgcggcgtcgaacgccgaatagtcctcgtcgtcctggtaccagcggtgcagcccttcgaacgcggtgatcgacgtgagcgtgaccgccgggttgatgcgccagtgcgcggtgagcgacgtgccccaggtcgagatgtgatcgctcgacggcgcgttgagcgacaccgtgtatggatcgctcgagccgacgaagccgaactggttcgcgccgcccggccccgcgccttgcgcgtgccacgcattgccgccgcccgtgtagttgcggccgtggatgttgaacaggaagttggtgtccgacgtgggcacggcgagcacctggaagcgcaccgcgttgtcgtggaagccgccgaagcgcccttgctgcaccgtattcgtgtagaagctgtcggcgttctcgtgatacaccgacacgcgcgcggccagcacgtcgttcttgccgatcggcccgccgatcgcggcctccgcgagccggctgttgtactggccgagcccgatcttgccgtagccgctcacgtcgaaggtcggcttctgcgacgtgatgctgagcgcgccgccgaccgtgttcttgccccagcgtgccctgcgggccgcgcagcacttcgatgcggtcgaggtcgaacagcgggaaaccctgcccgaacacgctgttgatgtacacgtcgtcgaagtacacgccgatcgggctcagcgacaggtccgacggatcgttgctgccgacgccgcgcaggaaccagcgcggccgctcgcggccctcggtcgattgcccggtgaagttcggcacgtacttcgtcacgtcgttgaccacgcgcagctcgttgttcctgatcgcgtcgccgctcagcgcgctcaccgcgaccggcacgtcctggatgctctccttgcgccggcgcgcggtcacggtgaccgtgccgaggttcgtttcgcggatggccgtgccgcgggtcgcacgggccgccgtcggtgcagccgcggctgcatcgtccgtgccctgttgtgccggtttcgcgtccggtgccgccgccaccgcaccttcttccgcccacgcgggcaacgatacggctccgcccgtcagcagtccccagcgcggtgacgattagtttttcctgaacatcgatgagtcatcctgtttgatcggttgaacgcacgtgcgtgcgcgacgcacgggttccctgttgcaattcggatgccagcctcgagaggcccgtcatatcgggcttccggcaggtatgcgggtgcgcgttgctgcatgcgcatctgtgaacggaagcaaactgcttgtcacgcaacactgccggatcgcgcgacacccgcttcgatggtcgtcaggagagctttgcagtcacgggccgcgacgcatcgcgccgcccatgtgcgacgcgcaacgcgcacgccaccagcacgacgacaggcaaccagcacagaaacacggcctgcaacccgacggccggcacgagcgcactgccggccagcgggccgcagaacgcgcccgtcatcgacgcgaggttgtacaggctcgacacctggctcttgtccgccgggtgacggccgaggcgctgcatgttgacgagatgcagcagcgacgagccggcgcacagcgcggcgagccccgcgccgacgatccacgcgtcacgggcgagcccgagcgcgagcaggccggccacggcgccggccaggctgagcccgtggcaacggcgcgcgctcagccgctgcgcgacatggccgagcccgaacagcgcgatcaccgcgaccacgccctgcaacgtcagcagcgcgacggcgtgcgcctgggacagcccgagcgactggatcgcgagcacgaccgtatacgcgccggcaagcgaacgcgtcgcactgttcacggcctccagcacgagttgctcgcgcacgtcgtgattccatgcgagcgccagcaacgcgcgcaggccgccggtttccggttgggcgccgcgcggcacggcctcggcgtcgccgagcagcgtccggctgaacagcgccatgcccgcgaagctcgccgacgccgcgcagaacgtcgcgaccgcaccatgcgcgccgatcagccagctcgcgagccacggcccgaccatgccggttccgaccgacatcgccgcgcggtaccagccggcgcgcgcgaggccgatctgcgcgagacgcgcgagaaacacgccgttgatggacacgatccggaacgggatgcacagcccgatcagcacttgcgtgagcgcgatcagcggccatgcgccggtatacggcacgacgaggttgagcagcatcggccccatgctcgcggcgaagtacacgcgccgcgcgccgtagcgcgcgacgagcagcccggccggcagcgtcatcagtgcgatgccgagcggttccatcgcggcgatgatgccgagccgcgcgctgtcgacgccgagcgcgagcgcatacagcgtcgtcgcgagctgcgccatgctgatcgtcgtgccgctcgcgagcgccagcagcatgaagccgccggtgaagcgctcgcgccgccatgcgtcggcgacgcgtgccggcgcgctcaccgcgcggcgtcgcgagacaacggtgcgatgccgtcgagcgcgcgccggtcgatccacgcgcgcacgtcgaagtccgcaggcaggaaccgccattcgacgaggaagcgcttgaaatcgtcgagcgcggcgatcgacgcttcgtcgagatccgtgcgcagccgccggtgcacgtcggtgccgtacgcgagccgcagccagtcgtgacccgatcccgtctcgcggccgagatagccgagcacttcctgctcgtgctcgcgcgcccagccttcgacgtcggtcacacgcgcgaggaagcggcgaacgatgtcgggatggcgttcgagcgtcgatgcattgacggtcagcggccgaggcgagccgttgttgatgcggatctgcggatcgggatgaaagccgatgtcgacgaccggctgcgcgccgatcaggtgcgcggtctcgagcccgagcgaacccttcacgtagatcgcgtcgacctcgccgcgcacgagcgcggccgcttcggccgcataaaggcgccggctggacaggctcgacggatggctgaatgccgcgtcgcgcgtcagcggcgtcgacacgggcgcgcgcaggttcgacgcgggcacgtcgacccattcgacgtcggcggggccgagcccgtcgagcgacaacgcgctgacgaagccgcgcagcgccgccgcgcggaagatgtcgatacgttcgccgtcgcggcgcggcagcccgatgcggcgcccgcgcaggtccctcggccgcttcaggccggtttccggcaacgcgacgatcgcctgcgcctcgtcgacccaggtcagcgcgaccacccgggtatcggcgccggaggcgcgcgcccatagcgcgggaatgctgccgccctgccggaacgtgttgtcgagcgaatgatcgacgtgcgcgcgatgcagcgccgcgtgctggctctcctgcagcgcgcggacggtgatgccgtcgccggcgaactcgctgtcgagccagccgagatgcgcggcgatgccgagcggcgtcggcaccggacagcgcgtgtaccagatcgactggacgtgatgggaagccgtgatgctcatggatgcgttcggaaaggagtcgtgaaccgcgcatcagccgcgcggcgcggtgagcaccgacagccgcgtgatgcccgcatgctcgatcgcggccatcagcttcgcgacggtgccgtacggcacgtgctcgtcggcctgcaggtcgagcgcgacgtcgggccggccggccttcagcgcggcgagctcggccggcaccgcggcgagcgcgaccgcgcgcttgtcgagatacacgacgcccttgtcgtcgacgctcacggtgacgttcggcttgcggtcggccggcgccgtggcgacggtgttcggcaggttcacgtgcaccgcgttgttgagcagcggcgccgtgacgatgaacgcgacgagcagcacgagcatcacgtcgacgagcggcgtgatgttgatttcactgagcacgtcgtcgttgtcggaagaggacgagaaggccattatgcgaacgcctcctgacgggtgccgtcggcacggcgtgccggcgcgggcgcggtggcggcgggcggcacgcggaaaccggccttctgcgcgagcgtgacgaaatcggttgcgaacgcatcgagatcggccgacgcggccttcacgcggcgcacgaagaagttgtacgcgagcacggccggcaccgcgaccgcgatgccgatcccggtcgcgaccagcgcctcgccgatcggccccgcgaccacatcgatgctcgccgacgcactgtgcgtgatcgcggtcagcgcgtggatgatgccgaacacggtgccgaacaggccgacgaacggcgcggtgctgccgatcgacgcgagcacggcgagccccgcttccgcgcgccggcgcgcgttgtggatctgctggcgcagatggcgttcgagcaggtcgtggcggctccagctgtgttcgagatcgtgcgcgctgctttcgtcggcgcggcgcagcgcgtcgaaacccgtcgcggcgagttcgcccacggggctgtcggcgccgtcgagcgcggccgcctcgtggaaactgttcgcggcccagaacgcgcgcgtgtaatgccggttgcgtgcgctcgcacgcaggctctggatcgccttcacgacgatcagcgtccacgtgacgacggagaagacgacgagcagccagagcgcgccctggacgatgaaggtggtcgggataccgttcatgatgtgagttccttgaaaatgtggcgggccgcccggtcggtcagcccagcttgaaatcgatcggcacgttgacccagccgtcgaccgcttcgtcgccgcgcttcgcgggcacgaacgtccagcgcttcacggcggccaccgccgcgttgtcgagcatgcggcggccgctgctcgtgcggacgtcgacggcatcgggcgtgccgttcgcgagcacgtgcacgcgcagcacgacgcgcccttcccagccctgctcctgcgcaaaggccgggtagtcgggcgccgggttgcgcaggtaggccgcgtcgccgatcggcgcggtttcgcgcacgggcgccgccggcgcggcgggtgcgggagacggtgcggcctgtgcggcagcggccggtgccgtcggcgcgggtgccgcctcgcgtgtgacaggctgcgcggcagccggcgcaggcgccggatgcgcgacggccgcacgcggcttcggcggagtcggcgcctgcttcagcggctgctgcggcttcggcggcaccggtggcggcggatgcgcggcctgcggcaacggttcgggcggccgcgtcagttcgaccgtcatcggcagcggccgcggcggctgcacgggcggcgcggcgggagcgcgcgcggccagcagcgcgacgcccgcatgcagcgccgctacggcaagtgcaatcgcacccgtgacgcgccaccggcccggcttcgccgcgcgcgcatccggccgtgcggcaggcgaagccgacggcggccatgcagcagccaccgcggcggccgcacccgcgcccgtgcgcggtgccgcacgtgccgcatgccggcgcgccggcggcacgccgtattcgatcgtcagacctgtcatgctcgactccttgcaatgacgcgccgcggcgcgctacgcgacccacgcatggcgttgccggtcgatgcgcgtgaacggcgccgggtcgatccatgcgcgcgcatcgaaatcctgttcgagaaaaccccactcgacgaggaagtccttgaacgccaccagcccgtcgatcgacgtctgcgcgagccccgtctccagatggcggtgcacgtccgcgccgtacgcatagcgcacccattcgtcggacgcgcgcgtttcgcggccgatataggccaccgtctccgccggatgacgcgcggcccagtcgcccgcgcccaccacgaccgacaggaagcggctcacgagatcggggcgcgcgtcgatcagtgcgcgatcgaccgtcagcgtgcgcggcgtgccgttgccgatccgcaccagcggatcggggtgcgcgccgagatcgatgaccacctgcgcgtcgatcaggtgcacggtttcgagcccttcgacccctttcacgaacaccgcgtcgacctcgccgcgcacgagcgccgcgatctcgatcccgtactcgtgcgggccgcgcgtaaatgatgccggcccggtgcggcgttcgcgttcgtcgggcaggtcgacccattcggcgtcgccgtgcccgagcccttccagttcgagcgcgctcaggaagcctttcagcgcggccgcgcgccagaagtcgatgctgatcggatggcgcggcaacccgagccgccggccgcgcagatcgcgggcggtgcggatgccgcgatcgggcagcgtgacgatcgcctggaactcgttggtccacgacaggccgatcacgcgcgtatcggcgccgcgtgcccgcgcccacagcgccggaatgttgccgccctgccggaacgaggacgggaggctgtgatcgaagtgcgattcgcgcttgccggcgtcggccgtttcctgcagcgaatgcagcgcgatgccgtccggcccgaactcctcgtcgaaccagccgcggtgcacggcgatgccgagcgcggtcggcaccgggcagcgcgtgtaccagagtgcgtcgcgggccgtggcctgcgcagcgagtgtcgtcatggtgaatgtccttgtcgttggaatgcggggatgccgttgcgctcatgcgccggccacgcgcagcgccgcctgcgtgccgcgcgcgttcagcgcgccgtcgacgagcggcagcacttcctcgcccacgcggtacgcctcctcgagatgcgggttgctcgcgaggatgaacgtcgacacgccgatgtcgacgtattccgcgagccgctcggccacctgctcgtggctgccgacgatcacgcagccggggccgccgcgaatctgcgacatcccggcccacaggttcgggccgacgatcaggtcgtcgaagtgctgcgtgttgccctggtgcagcgcgaactggcgtttggcaccgaccgattccgacgactcgccgcgcccgccgaagccgttgcgcgtcgcgtcgcccaccgtcgcgaacatctgccgcaactcggcccacgcctgcgcctcggtctcgcgcgccaggatgtcgatgcgcatgccgaagcgcaggtcgcgctcggcgttctggcgatcgagcgcgcggcgggccgcatcgatcacctccttctgtttcgcgagcggctcgccccagctcaggtgcacgtcgccatgcttcgcggcgaccgcgagcgcggcatcgctcgcgccggccaggtagatgcgcggcggtttctggccgctcagcggcggcagcaggccgccgccttcgacgcggtagaagcgtccgtcgaacgtgaacggctcgccggccgcgacgcccttcacgacgtcgaggaattcgtccgtacgcgcataacggctgtcgtggtcgatgaagtcgccgtacgcgcgctggtcggggccgccgccgcccgtgacgacgttccactccacgcggccacggctgatccgctgcaggctcgcggccatctgcgccgcgtagacgggatgcacgaaatgcggctgcagcgcgatcaggagccgcagccggcgcgtctcgcgtgccagcgcggccgccacgacccacggctcctccgtgaagcggaagatcgggatcagcgcgccgtggaagccggcgatatcggccgcgcgcgcgacctgcgacagatagtcgatgtagccgaattcgtcgtcgtcgactttcggcgcgacgcgcgatccgcgctggcggttccattcgccgcgtgtatgcaggtcgtgtgcgcgcctgccgtcgccatgcatcggcaggcgccacagaaattcaacagccatcggggttctcctggtcgggccattcggattgcgtgcggcatcggcgtgccgcccgtgtgctgcgctgtaaagcacgcggtgtgccaacctgcccgacgcggcacctgcgcggccgcctgcaaacctgcgcggcgccttgcacgccgggcgtcgacggcaaccggatcgcacccgcccggccgtggccggcacggtcgcgacaggcccgtgccgtgctgctgcatcggccgcaccgctgctgcgcgcgcaacagcggcccacgcgactgttgctggcgcaacaggccacgcatcggcacgtgcatcgccctttccgcgcgacgcccgcaccgcgtgcggccgcgccgtttccgtccactggcccggaacttgcaacgctgaccggcccgcgcgtgcgcaccgacaccgagcggcaccgcgcgcgaccgcgcttcgaccatgcttacgcagagaatctcacacatgacagacaggcccgattcgtcatcggacaagcagcagacgttctggtacgcccgatcgcccgtgccgaccccgcttggcatcgccgtgcatctcggctggctcaacggcgagacgtcggccgacggcgtcgcgatccgctcgccgcgcggcgccacgcggcacgacgtgtcgtcgatcagcgaccacacgctgacgcagtcgtttcgccagggcggcagcatccccgcgatgtgggcgcgctcgaacggcgcgaacacgcgcgtgatcgggctgtcgtgggtcgacgaatcgcagttgatcctcgcgcggcccgagtcgggcatccgctcagtgaaggcgttgcgcgggcgccgcgtcgcgatcccgagccgccccgacgaccgcatcgacatctttcgcgcgtcggcgctgcgcggcttcgtcaacgcgctgagcctcgacgggctgaccaccgccgacgtcgaactcgtcgacgtgcatgcacgcacgctgcaggccgtcgggccggcgcgcgcggcggacctgttcgcgtcgccgcacggcttctcgagccgcgcgctgtacgcggccgaagccggcgcgctgctgcgcggcgaggtcgacgcgatctacgtgaagggtcgaccggcctcgagatcgcgcagctgatcggcgcgcacgtcgtgatcgacatcggctttcatccggagcgctcgatccgcaacaacaacggcacgccgcgcccgctgaccgtcaacgcggacgtgctcgcgaaccatccggacatcgtcgccggcttcctgaagctcgtggtcgcggccggcgaatgggccggcacgcatcccgacgaaaccgcgcactacgtggccggcgaaaccgcgtcgtcgatcgactgggttcgcgccgcatacggcaaccagctgcaccggcacctcggcgtcaacctcgacgacgaatccgtcgcggcgctcgacgacttcaagacgtttctgcacgaccggggttttctggaagccgacttcgacgtcgccgactggatcgacccgcgcccgctcgccgacgtgctgcggccgtcgcggcagaaacgcgcgtgagcctcttttccgcccactgatcccgaccatcatgaaacacacgctctccctcgcttcgctgcgccgcccgctgcgtgcgctgttcgccgcgctgccgcttgccgcggcatcgctcgccgcaccggccgcgcacgcggacgatgcgcccaaggtggtgcgaatcgccgtcgtcgcctattcgggcggcggcaagacgcagtacgcgggcgcctctgcgctgatcgacgccgacaagtcgctcgaaaggcgctcgccgcgcggcacgtgaagctgcaatgggtaccggtgtcgaccgcggcggtcggcacgctcgtcaacgaggcgttcacgaacggcagcatcgacttcgcgggctacggcgacctgccgtcggtcgtcgtcaacgcgtcgggcacgcatacgcgcctgatcgtgccgggcggggtcggcagcaatacgtatctcgtcgtgccggccggctcgagcgcgaagtcgatcgtcgacctgaagggcaagcgcatcgcgctcaatcgcggccggccgtgggaagtcacgttcagcaagctgctcgcggagaacgggctgaagctgtccgacttcaggatctacaacctcgacccgcaggccggtgcggcagcggtcgcggccggccgcgtcgacggcttcttcacgctgtccgacgcgtattcgctcgtcgacaagaacgtcggcaagatcatctggtcgaccaagaccgcgcccgacgactggaagatgcgcgcggaactgtgggcatccgacgatttcgtgcggcgctaccccgacatcacgcagctcgtcgcgaccgcctacgtgcgtgccgcgcactggatctcgcagccgcagaaccgcgatgcgtacgtgaagatcctgagcgcgtccggccagccggaaagcgtcgtgcgccgcgaatacgcggacgaatcgacgccgtggaaggagcaatggacgccgctcttcacgcccgcgctgaccggtcactaccgcgacgtcgtcgcgtacagccgccaggccggcctgacgtccgcgccggtcgacgtgaacgcgctgctcgcgccgacgttcgtcgcgaccgcgctcaagcagctcgggctcgacggctactggcgcgcagacacggcgcgcgtcgcgagccgctgatgccgatgcacgccctcgcgtcgaacggcgcacgcgcgatccgcctgcccggcgtcgcgcggctcggcgggctcgcgctgtggtgggccacgcccgtcgcgttcgccacgctgtggtggctcgcgagcgcgcagcgctggttcccgccgcagctcgtcgtgccgcccggccggctcgcggcgacgctgcgcaccctgctcgacaccggcgaactgcgcgacaacctgctgatcacgctgcatcgcctcgcgctcgggttcgcgatcggcgcgacgggcggcgccgcgttcggcatcctgctggcgcgcagccggctgttctccgactacctgcggccgacattcgacctgctgcggcaagtgccgacgctcacgctgattccgctgctgatcctgctgatcggtgtcgacgagccgctgaagctcgtcgtcgtcggcaaggccgtgttcttcccggtcgcgctggccgcgtacacgggcgtgcacgacgcgccgcgcgacctcgtcgagatggcgcggcactacgggctgggccgcttcgcgctgctgcgcgacgtgctgctgccggccgcgctgccgccgctgctgactggcgtgcggatcgcgcttgcgcgcgcgtggctcgcgctcgtcgcggtcgagctgctcagcgccgacagcgggatcggccagatgatggaactcgcgcggcagatgctgcggctcgacgtcgtgctcatcgacgtcgcggtgatcgggctgatcggcttcgcgatcgaccggtcgatcgcgctcgtgcaacgctacgcattgcgctggcaagcgccctcgcgctgacctgactggatacgcttcgaaatgacgctcgccatacgctctctcgctcgccccgctgcgccgccgcgcgcgcgcctcgtcgtgccggccctgctggtggccgcatggcagttcgcgtcgtccggcgacgcggcccatcaatacgcgttcgtgccgttgcagcaggtcggcgccgcgctggtcgaactcgcccgcagcggcgaactcgcgaccgatctcggcgcgagcctgcgccgcacgacgctcgggctggggttcggcgtcgcgttcgggcttgtattcggtgcggcgatggcacgctcgacgctcgcgcgcaagctcggcgagccggcgttccaggcactgcgctacgtgccgctgctcgggctgattccgctgctgagcctgtgggccggcaccggcgaattcgcgaaggtgctcatcatcgcgctcgccgcgttctacccgatgaccaccgccagcttcgacgggctgcgccgcgtcgatccgcgctacgtcgaactcgcgcagtcgtatcgcctgacgcgcatcggcctgtggcgcgacgtgctgattcccggcgcgctgcccgacctgttcgcgggcgtgctgcaagccgtgccgttcgcgtggatcaccgcgaccagcagcgagctgctgttcaacgcgggcgcgggagtcggcagcctgatgcagaacgcgcaggccggtgcgcgcgccgacgtgctgctggtttgcgtgctggggtgacggcgctcgccgtcggcatgagtgcgctatgcgagcggatcgcgcagcgcgcgctgcgctggcgcgatcacgcctgacggcgcagccgcgcgtcggcgtcgcctccgtcacccgcatcgcgcggcttcaggatgccgagctgcgcgagccgcgcacgcacgatgttgcgcgactggtcgagcaggcgcgacatgcgcagctggttgtgctcgctgtagtcgaacacgctgcggtagacggtgtcctcgatgtgctgccagagcgacggcgtgccgagatccagcagctcgatcaccgcatggcgcagcgcatcggtcgcctcggccacgtcgcgcgcacggcgcggcggtgccgccgccggggcgcgcgggtcgtcggcatcgggcgcgagcgacagcgcggagaactgcaggtcgcccacgtcgatcgcgccacccgcgcagatcagcaccgcgtggtggatcacgttctcgagttcgcggatattgcccggccacgcgtgcgcatgcagccgtgcgcgcgcggcgtccgtgagcgtcggcgcggcgacgcgcagccgcttcgcataggtgtcgatgaagtgttcgatcagcggcgcgatgtcgccgaggcgctcgcgcagcggcagcaggctcagcttcacgacgttgagccggtagtaaagatcctcgcggaaattgcccgcgcgcaccgcggcttcgagattcacgttggtcgccgcgacgagccgcacgtcgatcttcacggtcttgcgcgagccgaccggcgtcacttcgcgctcctgcagcacacgcagcagcttgacctgcgcggacagcggcaagtcgcccacctcgtccagaaacagcgtgccgcgattcgcggattcgaaccagccgggctggctgttgatcgcgccggtaaacgcgccgcgttcgtggccgaacagctcgctttcgatcagcgtctcggagaaggcgccgcagttgaccgccacgaacgggccatcatggcgctcgctcagcgaatgcacgaggcgcgcgatcagctccttgccgatgccgctctcgccggtgacgagcacggtcgcgtcgctcggcgcgacgagctggatgcgctcgagcagcacccgcgatttgggatcgtcgaacgtcagcgccttcgcacggatcgtgatcgcatgcgaattcgggtccggcaaactgaagatggccatggcacgaccggcgtgttgaacggggaaggttcgacgatagcaaggcgcgcgccggggatgaaccaattcatcgagctatcggtatgacggcggccggattgcgccggccgccgcgcgagcgcacgcgatgtcacgcgagaccggtcatcttccattgctgctcgagcgcgcccggcccgaactcgagcgagccgccgagcggctccgcgagcgcctggaaatacgcggcttcctcgaggatcaggatgtacttcgacacgtcgaggatcgattttcccagaaggttgcgccgccgtttgcctcgatgatcgccggtacctcggggtcgcggcggatcgtgtcgacgatgaaacgcggctcgccgggacgacgatcgacgtacaccggaatctcgcgggcgcgcgtgtagcgcgcggccggcgcatagcggatcggcagcgggcgatgcgcgctcgcccatgcgccgagatacgggccgtgcacgtggatcacgacaccgacgtccggcgcctcgcggaacacgtccgcataacgcggcccgttgccgcccgcgcgcgcgtcgccatgcagcacgtcgccgtcgaacgtcacgacgacagactggatttcctgcgaggcggcccacgggctcggcgccgacagcgcgacgacgagctcggtgcccggcacgcgctggaacgcctggaacgtgttggtcgcggacagcgtgcgcgtgtccttcagcacgcgtgcggcctgcgtgaattcgcgcgtggcacgctcgacgaatgccacgagttcgccgctgtcgatggttggggtgacggacatgaggatggtttccttgatcgggtggacggagggaatcgcaacgcaacgtcgcgacacacgccgaccggatcagcagcaatcgtgccagccgggcgcgctcgcatcgaacgcccgcgccgcggtgcgggccggtcatgcacgacgcccgcggcacgatccatgcacctgcctttgttgcgggagcaacagcccgccggcccggattgctgcgcgacgcgcagccggcgcatgcgtgcggcacacgcggtacgacgcaacggcccgtcgcgccgcgcgccgcacatgaaacggatgcgctggttcgaaacttgcgtcgtgctcggcccgcgccatgcaccgtccggcgcttccgatccgatctcatcgacctccatccgaccatgacgctcctcccctgcgcggctgcgccgcgcgcgcactgctggcttcggcgctcgccgtatcgtctttcctctcgcacgcggcttcgcccggccgcgttcccgcgcccgacccgctgcagggcgacggccgcgtgtcggcgttctacacgtgggaccgcgacattccggcgacgcccggcgcgctgctgcgcaccgagccgctgcccgcgacgctcgggctcgcgagcgcggcgcgccagttgcggatcctctatgcgtcgaccgacggtgtcggcggtcacacgccgatcgccgtgtcgggtgcgctgttcgtgccgcgcggcacgccgcccgccggcggctggccgatcgtcgcgtgggcgcacggcacgttcggcatggccgacatctgcgcgccgtcgtggttcggccgctcgtatcgcgacgtgcgctacctgaacgcgtggcttcagcaggggttcgccgtcgtcgcgaccgactatcaggggctcggcacgccgggcccgaatccgcagctcaacaaccgctcgaacagctacacgctgctcgacagcgtgcgcgcggtactcggcggcgtgccgggtctcgcgaacgaggtcgtgctcgtcggccagtcgcaaggcggctcggccgtgttcgcggcggccggctacgcgcccgcgtatgcgcccgaactcgcgatccgcgcgaccgtcgccaccgggacgatctacaacgcatcgcccgccacgctcgcgtcgctgccgaagttcgacagtgcctaccggcgcgatcccgagcgcgtcgatccgacactcgcgtaccagttctactcggtgctctccgcccagcagatcgacccgtcgctgcgcgcggacgaagtgctgaccgaccaggcgttgccgatcctcgaacaggcgcgcatcggttgcctcgcgtcgctcgaggacgatgcggcgctcgcgcacctcacgcatgcgaacaccgtgaagcccggcggcgatgcacggctgaaagcgtggtgggacgcgtacctgacgtacccgacgctgaagatcgcgacgcccgtcttcatcggcgcgggcgcggacgacgggctcgcgccgctcgaactcgcgctcgcgaaggacgcgtgcgcggcgggcacgaccgtcgaagcacacctgtatgcgggccgcgaacacaacggcaccgtgaacgcgtcgctcgccgattcgattccgttcgtgaagcgcgtgcttgccggcgagacgattcacccggtctgcacgcccgccgcgcagcaggccgtgtcgcggtaacgcgcgccgcgcgctttgcacgccggcgcgaatgcatttccgaatccgttattggatcgcgccgccgcgcatttttatactcgtcagcactctcttccaaagagtgccagccaatctcgacagaacagcacaggacgaacctatgagcctacgccccttgcacgaccgcgtgatcgtgaagcgactcgaccaggaaaccaccaccgcgtcgggcatcgtgatccccgacagcgccgcggaaaaacccgaccagggtgaagtgatcgccgttggccccggccgcaaggatgcggacggccagcgcatcgtgcccgacctgcaggtcggcgagcgcgtgctgttcggcaagtacgcgggccaggccgtcaagctggacggcaccgagtttctcgtgctgcgcgaggaagacatcgtcgcagtcgtcaaccagtaacggagcgcaatcatggcagcgaaggaaatcattttcagcgacgtcgcacgggccaggctgaccgaaggcgtgaacattctcgcgaacgcggtgaaggtcacgctcgggccgaagggccgcaacgtcgtgctcgaacgcagcttcggcgcgccggtcgtcacgaaggacggcgtgtcggtcgcgaaggaaatcgaactcgcggacaagctgcagaacatcggcgcgcagctcgtgaaggaagtcgcgtcgcgcaccagcgatgcggccggcgacggcaccacgacggccaccgtgctggcgcaggcgatcgtccgcgaaggccagaagtacgtcgcggccgggctcaatccgctcgacctgaagcgcggcatcgacaaggccgtcgcggcggccgtcgacgagctgaagaagatcagccgtccgaccaccacgagcaaggaaatcgcgcaggtcgcgacgatctccgcgaacggcgaggaatcgatcggccagcgcatcgcggaagcgatcgaccgcgtcggcaaggaaggcgtgatcaccgtcgaggacggcaagtcgctcgcggacgagctcgatgtcgtcgaagggctgcagttcgatcgcggctacctgtcgccgtacttcatcaacaatcccgacaaacagatcgccgagatcgaaagcccgtacatcctgctgcacgacaagaagatctcgaacatccgcgacctgctgccggtgctcgaacaggtcgcgaaatcgggccggccgctgctgatcatcgcggaagacgtcgaaggcgaagcgctcgcgacgctggtcgtcaacaacatccgcggcatcctgaagacggtggccgtgaaggcgcccggcttcggcgaccgccgcaaggcgctgctcgaagacatcgcgatcctgaccggcggccaggtgatcgccgaggaaacgggcctgacgctcgagaaggcgacgctggcggaactcggccaggcaaagcgcatcgaggtcggcaaggaaaacacgacggtgatcgacggcgcgggcgatgcgaagaacatcgaggcgcgcgtgaagcagatccgcgtgcagatcgaggaagcgacgtcggactacgaccgcgagaaactgcaggaacgcgtcgcgaagctcgcgggcggtgtggcggtcatcaaggtcggcggcgccaccgagatcgaggtgaaggagaagaaggaccgcgtcgacgatgcgctgcacgccacgcgcgcggccgtcgaggaaggcatcgtgccgggcggcggcgtcgcgctgatccgcgtgcggcaggcgatccgcgaactgcagggcgtgaacgccgaccagaacgcgggcatcaagatcgtgctgcgcgcactcgaggaaccgctgcgccagatcgtcacgaacgcgggcgaggaagcaagcgtcgtcgtcgcgaaggtggccgaaggctcgggcaacttcgggtacaacgcgcagacgggcgaatacggcgacctcgtcgagtcgggcgtgctcgatccgaccaaggtaacgcgcacggcgctgcagaacgcggcgtcggtcgcggggctgctgctgacgaccgatgccaccgtgttcgaagcaccgaaggatgcggcaccggcggctgcgccgggcggcccgggtgcgggcgggccggggttcgatttctgacggcgtgtcgcgtgtgccggttcgccggcatgcgcgaccggcacgcacagcgaaacgcaggcaacgcgtggcgacgaaagtcgtcacgcgtttttgcatgggactgcgaaaacgggcagcgcgccggcccgccggcgcgctcgggtaagatgaacgcccgtccgccgccccgccgtccacgccatgccaaccgtacaaaccattctcgacgactacgaacgcctcggctggaccggcaacgatccgatgtcgcaaatgctggcgctgcggcgcgacaacccggcggcactcgccgacctcgtgatcgcttcgttcgatcgcgagctgtcgcatgcgaccttcctcgacgccgcactcgacctgatggacgacaccgctttcgcgaacgtcaccgccgcagcgtggcaacgcgtccgcgacggcgcatggaacacgcggctcgcgagcgtgttgtcgagcgcggcaatacaggcgccgcaggtatttgccggtcactgggacgtgtttctcgacgttgtgatcgcgaagcggtcgccgcacctgtactacgaggacaacgcgtggcgcatgctcgatccggcgacgatcgatgcatggcgcggccggcttgccgagccccctccggcgacgacgcgatgcgcgaacgcgccgtcgcgctgcttcattcgcgacaccccgcggccgttcgcgacgcggcggcgcggctgttttccgacgatccgggcaagtacgccaactggctcatgtctgccggctatgcgcaggaacatgacacgttgtgcgcgctgcatggcgagtcgccgctacacatcgacttcggcccgacgctgcgtgcgccgaggctccgcgagatgccgaagtggaaacgcgagattgacgcgcatcacccgacctggcacgcacgcgattcgcatcgatcgggcgcgcgcttcggcggcgtgtcgacgcatcgatgcggcctgtgtcacgagccgctgcatcggttgctgacgctaccgcaacccgcggcagccggcatcgacagcgcgacgcccgtatcgttcgacacctgcctgtcgtgcgtcggctgggagagcgacggcccgctgttccaccggcacgacgacgcaggcaacgcctgcgcgcacccgtcccagcaacgcgacatcgcgatccagcccgagtatccggcggccgcgttcgtggaggccgacgttgcgctcttcgccgcaccggcacgctggacacggcaggactggggcgaatcgaacggccggcagaacctgagccgtgtcggcggcgcgccgtcgtgggtacagtccgcgtggtatcccgactgtccggattgcggccgcaagatgtcgttcgtcatgcagctcgattccggcctcccgcaaacggacggcggcgaatggctgtggggcagcggcggcgcgaactacacgttctggtgcgcgccgtgccgcaccagcgcgcacctctggcagtgcacgtagcacgcaccggccacgcaacctttacgacctttttacttgcggacgcgcgtgcgttcactagaatgtgttcgccatccatcaccgagtacgcaccatgcgcatccgaagtcctcgccctccgagttgcttttctgcctgacaggcaggacgcctgcgtctctcttttcccgagccaccgtcctgccagcaggcggacggtgcgcgccgtagtcattccgtgcacgcttgaacacgacgtcgatgcgttgatcgcgcgtcgtgcgggcaagcgtgttcccgcggaacatcccttgcaacgtcgcgccatcgatccgccagcccggcaacgatcgcctggcatgcccgcatccggcatgtcgatccggtcacattgctttgcatccctgatttaacccgctgaagttcccgataccggagcccggtcatgttcgagatcgacaagcagtacacccgcgaattcatccataccgcgtgcggcggcggcaagcaggcattcctgccgacgaagaacggcaaggtcgtggccgcctgcctgcgcacggacctcaacccgcatgcgcccgacgtgatcctctgcgacggcagcgcgtcgcgcgcgcggccggcaggacgctcgccgcgcaacgtgatgcgattccggtgttcatccgcatggccacggacgcgtaccgcttcgtcggccggtacgtcgtcagcgaatcgctcaccacaccgctcgactgcgcgccttacgtgcgcaacagcggcttcacgcccgggcagatctcgcgcgtgctgaagctcaagcgctgctgacgcgcgcagcgcacgccctcccggtcgcctttcatcaaggagcaatcatgcttggcctgacgttctggaaacacgtgatcggcacacgacccgatgccgcccgcgacgatcgcgcaacggcactcggccggcaccgcgtgcgctcgaggacgctggtgctaacgagcgccgcggtggcatttgcggcgatcgcgttcggtgcgccggtcgtcggcatttccgtgttcttgctgacgacgttgccgttcgtgctgtcgggtacctgacgatgtccttgtcgggcatgcggcgggcgccatcgcaatcgatacgaaattttaatgcggcgcccccgcgtctctgacaccgtctttacacgcttttgtctaggatttccctgtcatcccgacacggagagatccgcatgcaaacgcagcaggccgccgccggccaacccgaccttccctaccgacgcggcggcgcaacgttcgcgaaccggctggccgacgcctgcccgccggataacatcctgctcgacgtaccggtcgaaagcgcgatccagttgttcgacctcgtcgcgcactatatcgagcgcagcagcggtgtgtccgcggaacggatcaggaccgaactgacgaagcgcgagcaactcggctcgaccggcctcggccagggcgtcgcgattccgcatgcgcgtgtcgccggcctccgctcggccatcgcgctgttcgttcgcgcgcagtatccgttccccttcgacgcaccggatcgcaagcccgtgcgcgaattcatcgtgctggtgctgccgcaggaagacaaccgcgcgcacctcgaactgctcgccgacgcggcgcgctgtttcagcgaacgcccgttccggcagtcgtcgcgcgacgcgctgacgcccgacgagattcaccagcgatgcaacgcacgtattgatgccgtcgtgatgccgcgtcgtgcggcaacacgcactcccttcatccatccggattcccatgttcccagaccctgaaagtcccaccccgacgtcgcgccgcgtagccggcctggcgcgctcgctgccgttcatgcaggccctgcacgggcagaccgtcgtcatcgtcgaaggcggcgccgcgagcgacgcacgcgcccgccacgcattcgcgcaggatgtcgcgctgctcgcactcaccggcgttcgcccgatcgtcgtgcagggcgtgccggccgcgtccggtacgcaatcgatccacgccgttcatgcggcgatggcgggcgtcaatcatgaactggtgcgcctgatcggcggtcacggcgccaaggcgatcggcatcgacggccacgacggcggcctgctggtggcgagcgcccattccgacggcactgacacgagcgcggtcgcccgcttcgacggcacggcgctgaacgcgttgctcgagaacgggctggtgcccgtcgtgatgccggtcgccccggacgacgcaggccatgatcacctgctgcgcgcggaacagctcggcagcctcttcgcgcagcgcaccggcgccgtcacgctggtgatgatggtcgacagcgcgctgctgcgcgaactcggcgagctcgccgggctctatggcatcacggaactcgagcaatggctggccgagcatccggccgcaaccgcagcgccttgcgtgcgggaagcgctcgatgcgctcgcgcacggcgtgcagaacgtccatctcgccgatatcgggcaacccgaatcgctgatcgacgaactgctgacggaggaaggatcggggtcgtgttctgccggcgcggcaacaccgacctgctggcggaaacccgccgctacttcgcggattcggcgagcgtgctgcgcgacggcttcaacgtcgagcagaagcaggtcgtgcggttctgaattttgcagcagaaccgctcgcggcgcggtgcgcagtgccgtcagaacatctggcgcaggccgacggcagccccgacgttgttggtcctgccgatctggtcgaccttgccggtgagccggttggtggccccggatagtcggccgcgaacgcaccgttgccgcgcgagaaatcgaccgtgccgtagacctccgtatgcttggacagcgcatactcggccagcacggtcgccgagtagttgatccccgagccgagcgtgccgtcgagccgctgcgcgttgcgtgcgtggccgtagtagccggccaccgtgatcagcagcggcgcggtggcctgccagttggcgccgacgtagaacgtgtcgtcgatgcggttcgggctgccgccgctcaacgccggtgcgccggcctgctgcatgttgaagtcggtcgtgcccgtcttgtcctggccgtgcagccagccggccagcaggcggacggagggcgtaacctgatacgcgccgctcacgtgcagaaagctcaccttcgcgccgttggtcgcactgccgttcacggacgataccgaggtctgctggaagcctgcgttgatcgacgcgggcccttgcgcgtaggtgagctcgacgccgtacgtgctgtcgaggcccatcgcaccggcatgattgccgaagccgtagatcgcatcgacgctgaacccgttgtacgtgaacgcgtacttcaccgagttcggtaccgtcaggtagttgccaatgccgttgtacgcccagctgtcctgccagtagtcgccgacggtcatcggatcgaatacgtcgcccatcgtgtcgtacaccggcgcgtactggttgccgaacgtcagcgtgccatatcggctgttcgacaggcccacgtaggcctgccggctgaacagcgtgttcgcgacgtgcagcttgccgtcgcccagctcgaaaccgttctcgagacggaaaatcgccgacagcccgccgccgagatcctcgctgccgcgcaagccccagcggctgtgcgtttccgggccgaccgtcattccgatcaggtccttgccgtcagggccggcattcgtctgataacggatcgccgtatcgacgaggccatacaacgtaaccgaactctgcgcgaacgtgcacgatgctgacatggtgaaagcggcgccgatacaaccggtgacaacggtgcgtctcatgaaaggcctcctgggcaattgattttgtaagcagtccgatagcattcgtggacggacgccattactgcgaacgggagaataatcggccatattcgcggcacctattaccgcttctggattggacctttccagcgtcgtcaacaatcgctgtcgtgcacgatgcggcggcccggcgcgatcgagatccgctgtcgcggcctgccggacggcgggcaaatcacgttccgccccaatgaatcgcaccgtgtcgaagcgcggcaccgatggttcgatgcccggctgtcggagcatggccacggcgcgcagagcggcaacgatcccgacacggtgcgtccttcgcgacccgatgctccggcgtcgaatcaggctcgggcggcatcgatccggaataccgcgatcgtcgcttccagctgccccgcctgcgctttcagcgccgccgccgctgccgatgcctgctgcaccagcgcggcattctgctgcgtcacctgatccatctgcgcgacggcctgattgacttgctcgatgccccgcgactgctcgtcggacgcggcggtaatctcgctcatcagtacgtcgacccgtcgcaccgacgccagtatttccgtcatcgtccccgtcgcgcgatcgacctgccgtgcgccggtgtcgacgcgcctgagcgaatccgtgatcagttccttgatttcacgcgatgccgcggcactgcgctgggccagcgagcgcacttcgcccgccacgaccgcgaacccgcgcccctgttcgccggcccgggccgcttcgaccgcggcgttcaacgacaggatgttggtctggaaggcgatgccttcgatcaccgtgatgatctcggcgatcttgcctgacgattccgacagcccccgcatcgtcctgacgacctcttgcgcggcctgattgccctgctcggtcagcagcgccgcgtcgctcaccacctggctggcctgcttcgcgttctcggcgttctggcgaaccgtcgacgtcagctgctccatggacgcggccgtctcctccagcgacgcggcctgttcctcggtccgttgagacagatccatgttgccctccgcgatctcccgagcggcggcgtcgatcgcgtgcgagccgttctgcaccgcccggatcgtctggagcagttcgccctgcatcgtctgcaagccggtcagcagttgccccatttcgtcggtcgaatgaatctccacccgggtcgtcaggtcgccttcggcgatggcgccgaaatggcccagtgcgttcgccagcggcgtgccgatcgcccgttgcagcgaccaccatgtcagcgtggccgccccgagcgcgaccaggctcccggcgaacgccatggcgatgaaccagtggaagcgtgcctgcgcggcatcgaacgtcgcccgcgaagccgtgatctggagctgtccgagcgcatccatggcgtcggacgcttcgatgaacagcgacggcgggatgcgtcgccagacttccggaattttgaccgcatcatgggtggctatgacctcgaacatcggctccagcccgttgtcgaccagcgccttgaacttgctgccggcgtcggccgcgcggcgggcctcttcggggccggagaacggcagcgcacgataggcctcccatgccttcctcgatgcggccagcatgtcgcgggccacaccggtttcctgcggaacttcgtcgctggccggatcgagcgcgatgcgatacagccacaggcgcgtcctcgacagcgcgacattcgcctgcccgagcgcctccgacgaagcgagccgttcggaatagagcgtcttcacgtcgttgtttccgattgccatgccgaccacgccgatgatgccgccgacaaccagcaatactccgagaaaacccatcgccagcgccagacgggtgcgaatgctgaaattcttgatcatggtcaggagagcgttgagcacgccgccggtgcatgcgacgcatgcgcgtgaaaccagtcgggtacggcacgtgcaaggtcgacttcccgataacgaccaaagtgacgccgggattaacgcagaatccgtaacggacgtttccggaagcggcgagttgtgatccgcgcgagtccgtgatagcgaggtgtgcaacgcttgcacgccgaatcgtccgatgaatatccaggtgcccgggcactggcgggcgcacgtgtcgcgtgatggcatgccaatgcgcccctgcgctcacgtcgggctgctttcgaccgtgcgcgctgcgtaccggcttccacgcagattgatctggataacaaaccattcagccgccctgcccgaagcgcgccgatcatgcctcagccgctcggcgagcaatcaacccgcaggaccgctgctcgccagcgtcctgctgcgcagcccggccgggccatgcccgaacttcgtgatcaccacttcgaccgcaatcgcgcaacgcagcgccggcgggatgccaggcgcaaggcacggcgcaatggcgctcccgtcaatgcgccggttgccgatccggtgacaggccgtgcccgatacgacggccgggctatggaggatggggcgcgacggatggatgctcacagaacgtcgagcggcgcgccatgcccgcatcgccacgcaaatgaggccgcttgcgacatcccgttgccgggcgccacaagcggcctcctcgcagacggcatgcgtcagcgtcgcgtcgccagccttctcacgacgctcaccagcgcgtcgacttcgtcgcacgtgttgtagaacgcgagcgacggccgcaccgttgcctcgagcccgaaccgccgcaggatcggctgcgcgcagtgatgccccgagcgcaccgcgatgccctcttcgttcagcgcctgcccgacttcctcggtctcgtagcccttcagcacgaacgacagcacgctcgccttgtcgcgcgcggtaccgacgaggcgcacacccggcaccggtgcgagcacgctcgtcgcatacgcgagcaggtcgtgctcgtagcgcgcgatgttctcgatgccgacccggctcacgtagtcgagcgcggcacccagccccaccgcatccgcgatgttgccggtgccggcctcgaaccggttcggcggcggctggaacaccgtgcgctcgaacgtcacgtccgcgatcatgttgccgccgccctgccagggcggcatgtcgtcgaggatcgcgcgtttgccgtacacgacgccgatcccggtcggcccgtagatcttgtgcccggagaacacgaagaaatccgcatcgagcgcctgcacgtccacgcgcatgtgcgagatcgactgtgcgccgtcgacgagcgccttcgcgcccgcccgatgcgcaagctcgacgatctccttcaccggcacgaccgtgcccagcgcgttcgacacctgcgtgacggacacgatcttcgtgcggtcgttgagcagcttccggtattcgtcgagcagcacctgccccgaatcgtcgaccggaatcacgcgcagcttcgcgcccttgagcgcggcaagctgctgccacggcacgatgttcgcgtgatgctcgaggttcgacacgatgatctcgtcgccttcgccgacgttctgcacgccccacgacttcgcgatcaggttgatcgcctcggtcgtgccgcgcacgaacacgatctcgtccggcgacgaggcgccgatgaagcgctgcaccgtttcccgcgcgtgctcgtacgcatccgtcgcgcggccggccaacgcatgtgccgcgcggtgaatgttcgagttctcgtgtgcgtagaagtatgcgagacggtcgatcacggcctgcggcttgtgcgtcgtcgccgcattgtcgaaccacacgagctgcttgccgttcacgcgctcctgcaggatcgggaaatcgcggcggatcgcgttcacgtcgaacggcgggtgcgcaccgcgatacagctgaccttgcggctcggctgcgtgcgtatcgtcgatgaagtagcgcggcacatcggagcccgacgcgcgcgacgccggcacgtcgcgatgcaccgcgagcagctcgcgcagcgcgtcgtcgcccggcagcccgaacgcttccggcgacgcgaggccgttcgacggcacgacgatgtcctgcggcgtcgcctgccagccctgcagcgaaccgtcggtgaagtagtacggcgatgccttcgccgcgccttccggcgccggcgcattcacttgcggcacgccgagcgccgcgccgccgacgcgcggttcgagcgcgggcgcgatcgacacggcgctgtcgggcagcccgttctgcgcggccgcatgcggcgcgagcgccggtgcgcggttgccgagcgacagcacgtgggtcggtgcggacggcgcgaggttcgcgccgggcaccttcccttgcgggagcgcgagaccgggcacgccggtgcccgcgccgcccggccccgcgagcggcgagccgcccgggaccgggttgctcaccgacgccaggatcggcgcggcggccggcaaggccgacggcacgccgccgaccgcaccgctgcccgccgacaacccgggcgcggtggcctgcccgggcggcgtcgagaagaactcggacgcgagccgcgcaagcgtcgcgggatcgggcaagccggccggcaacggcgcgtgcggcagcgcatgcgcgtcgccgccggccaggccgggattaacggtaggtgtcgggatagtcatggaacttggcgatttcgacgtcatcgaggacagccagcgcatccggcgaatggaccgcgagcgagcaatacagcgagatcaggtacgacgcgatcgcctggttgttgatccccatgaagcgcaccgacaggcccggaccctgctcgcccgcgacacccggctgatagaggccgaccacgccctggcgcttgtcgccgacgcgcagcagcaggatcttggtcttgccgtccgcgaccggcaccttgtccgacgggatcagcggaatgccgcgccacgtcaggaactgcgagccgaacaggctgaccgtcggcggcggcacgccgcgccgcgtgcattcgcggccgaacgcggcgatcgcgagcgggtgcgtgaggaagaacgcgggctccttccacaccttggtcagcagctcgtcgaggtcgtccggcgtcggcgcgcccgtcagcgggaagatccgctggtcgtcggtcacgttcgcgagcagcccgtagtcagggttgttgatcagctggctttcctgcagctccttgatcgtctcgatcgtcaggcgcagctgttccttgatctggtcatgaggactgctgtaaagatcggagatccgcgtatgcacgtcgagcaccgtgctcaccgcgttgaggaaatactcgcgcggctgttcctcgtacggcacgaaggtctgcggcagcacgctttcgtcctcgagctgcgtgcatgcggcacgcacggcttccgggttcttcacctggttcaggcgatagatgccggcctcgaccggtacccattgcagcagatgggtcagccagcgcggcgtgatcgtggaaagctggggacggtcttggtagcgttcgctagttggcgggcggcgtgatcgctcagcgcagccgcgccgcttgcaacggtcgacatgtgtggctccgggttcttaagatgaaaaacgggattgcttatgacgctgggtgattatcggaagcacgcacctgccggctcaacatgctatagccgtcatgtcgcgtgcgaccgaaagggaaaggtgacgaggcggcctcaggtgacgaacgtgcccggcagcagcgtcgagatcgatacgtcgaacgcgcgcgcgatcttgtccgccgtgacgatcgacgcgatcgcctcgccgcgctcgatctcgccgacatacgaacggttcagccccgcatgctcggccagctgttcctgcgaccaagtgcgcgcttcgcgcagcctgcgcacgttggcgccgaagtgatggatgaggtcgctcatcgcgcctcctaggcgacacgcgccgccgcgcgcggcgtggcgttcgtttcgctgcgcagcaccgcctgcgtgatgttctcgccggccggcacgtcctgcgtgagccacacgttgccgccgatcaccgcgccgcgcccgatcgtcacgcggccgaggatcgtggcgcccgcgtagatcaccacgtcgtcctcgacgatcggatgccgtgcgagccctttctcgagatggcctgccgcgtcgcgcggaaagcgtttcgcgccgagcgtgacggcctggtacacgcgcacgcgctcgccgatgatcgccgtctcgccgatcacgacgccggtgccgtggtcgatgaagaagcccgcgccgatgcgcgcgcccggatgaatgtcgatgccggtctccgcatgcgcctgttcggcgatgatccgcgcgagcagcggcaggccgagcccgtacagctcgtgcgcgagccggtggtggatcatcgcgaggatgcccggatagcacagcagcacctcgtcgacgctgccggccgccggatcgccgtggaacgcggccagcacgtcgctgtcgagcagccggcggatctcgggcaggcgcgcggcgaacgcctgcacggccgtcgacgcgacttcgtcgacatgatcgaccggcccgtcggcattgcgctgccgcgccgcgtagcgcaattccagcttcacctgcgcgagcagcgcgttcagcgccgcgtcgagcgcgtgggccacgtggaagttctcgctctcctggcgcagctcgggcggcccgagccgcatcgggaacagcacgcccttcagcgcgccgatgatctgcgcgagcgcttcgcgcgccggcaggtcgcgcccgcccggttcgagcgagcgccgctgcttctcgcgccatgcacggcgtacggtctgcagcgattgaacgatgtcgtcgatgtcgaatgcggccatgctgcgttctcctgtctcggccgtgaatcagtcctgtgcccacggcaggccgcgaaagcgccagccgttgctgacgccgcgatgctgccgttcgtcgaggtcgccctcgaacccttcgagcacgttgaatacctgcgtgaagcctcccttcgtcgcggcctcggccgcctgcgccgaacggttgccgctacggcacaacagcagcacgacggccgccttgcctgtcttcgcttccagttcgcgcacgaagcgcggattgcgcgtcaggctcgtgccggtcgcccacggcacgtgcagcgattccggcacgtggccgacgaatttccgttcctcggcggtgcgcacgtccaccagcagcgcatcgccggacgagaacagcgcccacgcgacttccggcgcgacaccgcccgcatagggcgtaccggccgccgcagcggccgcgcgcgcgtcttcgagcgcctgctgcgcggcagttcgttcttccagttcaaccgtcatgacacttccttgttttcgcggattcgtatgaacaaaaacaccgggaatgcggccgttgcagcttgcgtgctgtctatagccgtcagcgccactatgcgagggcggccgggaagctgaaccaataaaaattcatttcctaatcagcgttgcgggaatgcaatagcagacgcgcgctatcggcgcggctcgcgggcgagcaggacaggcgcaatggaggccgttcgatgtcgcgcatcgaaggtgttcgaaaggaatcgcgggagacgatcaacgcggcgggtggcgcgttgggatggaagcggaaatggaacgcaggcgctggcgcgcctgcatggatgtcgcaagaaatccggctgccggcaggcgtctgcacgatgcctgacgggcatcgccgacgcattcgcttgtgcgtctgccggtcactgtaccgggtcgaccggcgcaaccggcacgccgcgcgcttcgatgtcgcgcccggcgagcaggcacagatcctcgcgatggtgcgcggcgaccacctgcacgccgaccggcacgccattctcgagcgacgtcgtcacggcgagccccggcagccccatcgccggcagcgcgcgcaacgtgagctgcgcctcccacacgcgatcgaacccgtcctgcccctgccggtcgagatcgtccgggaacggcagctccgacgacaccggcagcaacacgaccgcatattcatcgagaaacagccgccactgtcgcgtcagcgtcgtacgccggacgagcgcgcggctgatcacatcggccggcaggtcgcgcaccttgccgcgcacggcctcgaccaccgccgccgcgcccggatcgccgtcgccggcaaccgcgttcgccagtgcatcgaaaccgtcgccgagccagagctgctcctgcaacagcgcggcctcacgcatcggcggcgtgtcgtcgatctcgtcgacggtccagcccgcatcgaccagccgtcgcgcggcatcgcgcaacgcggcctcgacttcgggcacgacctgcaggccgcccggccgcacgcacagtgccgcgcgcttcggcacctcgcatccgtcgaacggcaccgccacgtgccacgggtcgcgtgggtccggcgcggcgaacgcccgcagcgcgagcgcgagatcgtcgatcgtgcgtgcgatcgggcccgccgtcgacatcaactgcgcaccgatcgctcgctcgggcgacgacgcgttgaacgccggcacgcgcccgagcgacggccggattccgtgcacgccgcatgcgtaggcggggtaacgcaccgagccgccgatgtcggtgccgacggcaagcgggccgattcccgcggccacggccgccgccgcgccgccgctcgatccgcccggcgtcagcgacggatggcgcggattgcgcgtgtggccgtgcacgagattcgacgtgaaccagcgcagcgcgaacgtcggcgaattggtgcggccgagcaggatcgcgccggcttttctgaggttgccgaccaccgggctgtcggcatgcgcgatcaggttctcctgcaggcgcgtgccattggtcgtcgcgaaacccgcctggtcgacgttgatcttcacggtgacgggcacgcccgcgagcggccccggatcgtcgccgcgcgcgatcgcgcgatcgacttcgtcggcctgacgccgcacgtcgtcgggccggtgttcgatcaccgcgttgatcgccggattcaccgcgtcgagacgatcgagcacggcgtccgccacttcgcgcgcggacacgtcgcgatgccggacgcgtttcgcgagttcggttgccggcagttgccacagttgcgtcatgactcctcctcgtgaaaagacatctccgtcactcgcgccaccgcgcttcctgcgaaagcgcggcgccgcgttcactcactgcgcaccctgcttcgcgcgttccgccgccgcgatgatcgcatcggccacggccttcggctggctcagcatcgacacgtggctgccgttcacgcgcgcgaccgtcgcgccgatccgcttcgccatcgcttcctgcagcgtcggatcgatcatcctgtcctgcgtcgcgacgacgaacgtcgacggcttcacatgccacgcggcctgcgtgaccttctccgatatgcacccgccgtaccacggcccctgggtcgccgcgacgatgcgctgctgcgcgggcggcaggtccggcgcgaaatcctgcgcgatcgccttgtccgacaacgtggcgaagccgcccgcgtccttgcgcagttcgccggcccatgcgggtgccggcagcccctgcgtgacgtccgcgatcgactggccgttgtcgggcgcgaacgcggcgacgtacacgagcgacttcaccttgtcgttgttgcccgcgtcgctgatcacgacgccggcccacgaatggccgaccagcacgaccggccccttctgctcgtcgatcgcgcgcttcgtcgcggctgcgtcgtcggcgagcgagctcagcggattctgcaccgacaccacgtgcagcccgcgcgcctcaagcagcggaatcacgcggttccagctcgacccgtcggcgaatgcgccgtgcacgagcacgacgttcgtgcccttcaggtcgtccttcggcgcagcctgcaccgcgaccgcaccgaacagtccgccgatcacggcggcggacaccagaacgcgtttcatcaaaccggccatcgttttactccttgctctgttgtgttgtttgaacgtgccgcggtagcggctgcgcctgcgcacgaggcaggcgcggctccggatcacgaatgcgcgtacaggtcgtcgtaagcgttcggcgcggaatgcgcttgcgccgcgccgcgatggccggcacgcgtcgatgcgtcggccacgttgtcgccttgcgacttcgacgggccgttctggtcggaacgcgcgatctgcagcgcggcggcgacgtcttccgggtaatgcggttcgctacgcgccgggttgtagccggcctgctccaggcggacgagttcggcgcgcacgtcggcacgcgtgaggccgtggccggtgtcggcaaacgacagggcggggatggcggcgaggacggcaacggcgaggatgcgagcggctttcatgagggttctccttgaaggaagtaggtcggtcgatcattcggcatccgatccagatcgtctggcatcgaacgtttcctgcatgtcgacagtagaacccgcccacgtatccggcatgtttccggaaccggggctttctgcatgccagtttttcaggaacggccgcagatacagtgcgatacaaaccgggctaccgcatcgttcatggcccgctccgctgacgttctccacgaaagcacacccaccatgaaaaaggcgtgccacgcatggcacgcctttccgtagaacacatcgaaccgggtacgtcacggcgccagccgcgtgaacacgtagtcgtgattcttcacccgcgcctgatggcacgcaaagcacgtctgatgctggccgatatcggccggcacgccgttgatgaaccgcccgaagccccagccgcccgtcgacgcatagcggcgcgagtccttcaccatcacctgcacggtcgtcgcctgtccgggcaccgtcgccggcgcgaactcgtcggactgcttgcgcttgtacgcgagtttcaccaggatcgtgccgtccggaaacggcagtgtcgcctgctcgagcgcacggatcgcgacgggattgccgagcacgacacgcagttcatcgagcggcgcggcttcttcggccggggcgaccatttcccacttccggtagccgggcgggatcgtcacgccgtaaatcggcgacgcggcggcggcagccggcttcggctgctccgcgaacgcggccgggccgctcgccgaccacgcgccggccagcagcacgcccgcgacgaacccgcggcgcacgccgcgacgcacgccacccatgcgcgcccgcatcacaggtgctccacttgcaggatcgcatccgcgaacgcctgcggcgcttcctgcggcaggttgtggccgatgccgccggtgatcgtgcggtgctggtacttgccggtgaacttcttcgcgtacgcggccggttccggatgcggcgcgccgttcgcatcgccttccatcgtgatggtcggcaccgtaatcgcagggccggccgcaaggcgccgctcgaggtcgtcgtattgcgcctcgcccttcgcgagcccgagacgccagcgatagttgtggatcaccaccgccacgtgatcggggttctggaacgacgcggccgtgcgcgcgtaggtttcgtcggagaactgccatttcggcgatgcgagctgccagatcagcttgttgaacgcgtcgcggttcgccgcgtagcccagcgcgccgcgctcggtcgtgaagtagaactgataccaccactggaattcggcctgcggcggcagcggcttgcggttcgcctcctggctgccgatcaggtagccgctcaccgacaccagcgccttcacgcgctgcggccacagcgccgcgatgatgtcggccgtgcgcgcgccccagtcgtagccgccgaacaccgcgcggtcgatcttcagcgcatccatcagcgcaatgatgtcgacggccgtcacggcctgctggccgttgcgcaccgtgtcggccgagcggaacgtcgtcgacccgtagccgcgcaggtaaggcacgatcacgcggtagccggccgcgacgagcagcggcgcgacttccgcatagctgtagatgtcgtacggccagccgtgcagcaggaacacgaccgggccgttcttgggcccgaggtccgcatacccgacgttgagcacacccgcgtcgatctggtggatcgtgcccagcgacgcgacgccggccgcgcgcttcgcaggcgctgcatcgggcgccgactgcgcgtgcgccagggcgctgaagccgaggtcggcgaggctgaggctcgccagcgtcgtacccaggatcaggcggcggcgggtgttcacggtttcgggcatggctcgttctccagtgtcgatcgctaaggaaggtgacccgcggcacgtgcgggtactcgggaatctgcgttctcggcagcggcgcatggcatcgcgccgccgtgtgaatcgcttcaccggttttatacccgagccctggcgaggctttgtatcccaacgtatctgtcggcgaacacgacacacgacgattcaaaaatcgggcgggaatgcgggttcgcagggggccatgtgccacgcgccggcctgccccggcgatggcgtggccacgcaccgcctctcgcttcggcgccgaaacgcggcgatactacgccgcttgccgtgacaacccgcccgattgcaggtgaccgaattgaccaatgccgacgaacaagacgctcccgtgcgacaggcgggcacgaacgggccgccgctctggctcgcgaccatcctgaccgcgttcgggcttgcggcgctcctgctcgcgtggttctccggatacgccaccgcctactgcgacacgcttggcgatgccgtcgtctgggtcgtgtttgtcacggcggctttcgtttttgccgccttcaggtacaactggaacatttttccggtcgggctggttgcctgcatcgcgctcgccgcggtcgtccggcggcttccgcgtttcaaggtcacctggcgtcgatttttgatcgtgctgccttgtgtctatgccgcgatgacgcttttcacgtggctgagggacgtacacggcacgtgccggatcatctgagggtgaccgccccactccgccgatgaacaccggccgcatgccggccagcccgcattcaccgctcggaccacgccgctgcacgcagccgttcagtccttccggtccggcaggatatgcgcgcgaatcgagcggccccgccacgagatgtgatcgatccgggcgcgcagcgtgtaaagcgccaccgacgacagcgtgtcgaaccggagcagcgcgatggggtgccgatcccggccggcacgcgctcgatcgcatcgaacagcgggaatccatgccgcgccaggaacgcgccgacctcgtcgtcgcgcgcgtgttcttcgacattgaccagcagtagttcagccatgaggattccttgctcgttcgcccgtcacccgatcagccggtgcgtatggcgcgcgatcatcagctcttcgtcggtcgggatcacccacgccgatacgcggctcgatgccgtcgtgatcagcggcccgtccgtgccgttcgcgccgacttcgatctcgacgccgagccacgccgcacggcgcaacacccttcgcgaaccgccgccgcgtgctcgccgatccccgccgtgaacacgacggcgtcgatgccctccatcgcggccgcaagcgaaccgagttcgcgcgcgatgcggtagacgtacagctcgatggcgaagcgcgcgtgcgggtcgtcgctcgcgagcagggtgcgcatgtcgctcgacaggccggacacgccgagcaacccggaacgccgatagagcagatcctcgacggcgcgcacgtccatcccgagtgcttccatcaggaagatcacgacgcccggatcgaggctgccgcaacgcgtgcccatcggcagcccgtcgagcgccgtgaaccccatcgtgctcgcgacgctcttgcctgccacgagcgcgcacatgctcgcgccgttgccgagatgggcgacgaccgtgcgcccgcgcgccgccgccggcgcgacgtcgggcagcacgctcgcgatgtactcgtacgagagcccgtgaaaaccgtaacggcgcacgccccggctggtgatcgacgcgggcagcgcgaacgcctgggtcaccgcgggctgcgtgcagtggaacgccgtgtcgaagcaggccacctgctcgacgccgggctgcatcgtttcgaggatacgaatcggcgtcaggttgtgcggctgatgcaacggcgcgagcggggtgagtttctccagctcggccacgatctcgggcgtgacgcgcaccgggccgctgaagcgttgcccgccgtgcacgacgcgatggcccaccgccgcgagacggtgcccttcctgatgcgcgcccaggaacgcggcgatctgctcgagcccttcctgatggccgaacgtatcgccgccggcccattgccgttcgtgacgctccgcgtggcggtcgacggcgctgaagtgcgccgtggccgtgtacaggccctcgacctggccatgcacgatcaggccgagcgtgtcgccgtgcacgtcgaatgcggaaaacttgatgctcgacgagccggcattcaacaccagaatcacgtctgccatggcgtcaccccgcgcgccgggccgcttcgcgctgcacgttcgcgacgagcatcgcgaccgcacaggaagccagccgggtgatcaacgaatcggcacgactcgtcaggatgaccggcacgcgcgcgccgagcacgatgcccgccgcatccgcgccggccaggaacgacaggctcttggcgagcatgttgcccgcttcgaggttcggcaccatcagcacgttcgcgtgcccggccaccggcgaatcgatctgcttgatgcgcgcggcttcgggatcgatcgcgttgtcgagcgccagcgggccgtcgacgagcgcgccggtgatctgccgccgatccaccatcttgcacagcgcggcggcttcgagcgtcgacggcactttcgggttgaccgtctccatggccgagaggatcgccacacggacctgcggaaaatccagcgcatgcgcgagatcgatcgcgttctgcaggatgtcgaccttttcctcgagcgtcggcgcgatattgattgccgcgtcggtcacgatcagcggatcggcgtgcgcgggcacgtccatcacgaagcaatggctgatgcgccggcccgtgcgcaacccggaatcgtgccgcaccacttcggccatgagttcgtcggtgtgaaggctgcccttcatcagcgcggacgcgcggccgtcgcgtacgagccgcaccgccgccgctgccgacgcctcgctgtacggcgcatcgacgatctcgtagtcgccgatcggtagctgcaactccgcggcggtcgcttcgatacgcgcacgcgggccgaccaggatcggctcgatcagccccttgcgcgccgcctccagcgcgccctcgagcgagcttcgatcgcacggatgcgcgacggccgtcggcatcggcgcgagcgcctggcagtgttcgatgaggcggcgatatttctcgtgtcgggtttccattgcggttcctcgctgtccgtcactgcacgcgttcgagtgtcgccagcggcccctggccggtagcgtggcaggcggcgcgcccagtaccgcgcgaatgcgttgcagcgccgcccactgttgctcgctcaccgacgcgctttgcacgcgcgcgtcgcccagcagcttgtccagcagcgtcagcagccgctggcggtcctccggccgggcaagcagcaccggcagcgcggcgacggcctgttggggcgcgtaagtcgcgatgatctcctgctcgccatagatgcgccgccactggtcgggcggcaggttcggcaggtattcggcgtaggtttcggcaagctcgcgctcggtcgcaagctgcgccagcgggaacggttcgccgctgcgctcgagcagaaacgccgcgcgcgcaaccgcttcggtgtagccgccacgctcgatcgacgcgagcgccgccttcacgaacggcaggtcgcggggtccgccgccgccggcgcagcagcgtgacggtcgcgatactgctcccgaaatgaagcatggccggctgggtgtacagcgagaagaacagcgactcgatgcttgcatcgcgcatcgcgcggaaacaatcgagcgacgcgctgacgatatccgagccacgccgttcgagcttgcgccacggctcgatatcgtcggccggctggcggtgggccctgaccgtgtcggcggcgggcttcagccagcgaagccagggattcaggtccgaaaacgcccagcgctggaagcgcagcggatgaaagtcgcgcaacaggtgcgccgtggtctcgttcgatgcctgctgcacgtatggctgcatgaacagttcatacgcgcgctgcgtgaattcggacagcgcggcgacggcctcgaacgcttgctcgtccttgcgcccgaagcggttgaagtattgcgcgatctcttccagacggtgctcggcgaaggtgacgtcgtacgtgaccttcccgtcggcgccctttacctcctcgatcgacatcgcatagaggccgggcggcagcgtttcgacggcatccagcacgctgacgatctgcgcgtgctccttcttcgcgaccttgccggacacgaagatgccgagatgccccacgtcctcttccaccaacccgatgatgacctgcccgcgcgacttgatctcctccgtgctgccgtagatgtccgtgacccagttgaacgcctgctgcggcggcgtgatgttgtcgcccatcgacgcgaacaggatgatcggcgagcggatctcgcgcaggtcgaacgccttgcccgatccgtctttcacttcgccggaccagagcttgttgccgatgaacaggttgcgcgtgatccattcgatctcgtcgcggttcatcaggtagtagccgccccaccagcgctcgaactcgaggaagcgcggcggctcggtgtcgatgtggtcgtacacgtggtaatacttgtcccacaacgtgttcgccggattcaggttctcgaagttctgcacgagataggcgccgtcgaacttgccgttgcccaggtccgacgcgaacgacgcgagccacgtgccgccgagtatgccgccggcataacgcatcggattgtcgccgggcccgtcgctccacgcgccgctccagtacgacatcggggcgccgttgatgacgatcgggcccgtatcgtccgccgacgaactcgcgagcatcatcgcggcccagccgccctggcagttgccgacgatggccggcttgaggctgtccggatgcaactcccgcactttccgcacgaacgcctgttccgcggcgcacacgtcgagcaacgtctggccgggctcgggctcctggaagaacacgacgaaatacacgggatgccccgcgcgcaacgccacgccgacttgcgaatcgtccttgaagccgccgataccggggccgtgcccggcacgcggatcgatgatcaggtagggccgcttgccggcgtcgacgatcacgccatccggcggctggatgtgaacgagcgcgtaattgacgggccgtgcgaactgccggccgtcgagcacgacgtcgtagtcgaaatgcagcaccggcttgagcccctcggccatgcgctcgacatattgcgtgccgcgctcgcgcagcgtgtcccagaacagcagcgcgctgcgcggcgtcgaccgcgtaatgccacgcgcccagcggcgagaacggcatggcaaacggggcggcgcccggctcctggccggggccgtcgctgccgtcgagtgcttcgcccaaccgtttcccgtactgttccagcgcgtgctgcgtgcgcttttgcaggacgtggacaatctccgtggcgatctcatgactgcgcgccagttgcgtggcagcatccataacactgttctccagaggggcaaggtgaatctcgacgcattccgggagcggccgcctcgcgtcagccgagtacgtgcatccccgcgtcgatgtagtgaataccgccggtcatcgcgcgtgcggcatcgctggcgagaaaggtgcacagcgcaccgacgtcgtcgatgtcgagcggccggcgcaatggcgcacggcgggcggtgtcgtcaagcaggtgatcgaagttcggcagcccggaggccgcccgcgtggccagtgcgccaggcgacaccgcatgcacgcgaatgccggccggccccagctcgacagcgaggtatcggacggcggcctccagcgccgccttgaccggccccatcacgccgtactccgcgatgacctggtcggcaccgatataggtcatcgccatcaggcttccaccggacgccatcaacggctcggccagtttcgccatcctgatgaacgagtggcaggaggtatccatcgcgagagcgaacccttccggcgaactgtcgacgacccgcccgtgcagatcggccctgggtgcataggcaacggcatgcaacagaaaatcgaggccgccccactgttcgccgatcgtgtcgaacacctcgcgcatctggtcggcccggctcacgtcgagcggcatcgcaatcgccggcttcagctggtcgagcagcggctcgatgtacggcaacgcccggtcggattgccaggtcaccgccagctcggcacccgctgcatgaaaggcgcgcgcacatccccacgcgatgctctgctcgttcgccaggccgacgacgatgcctcttcgaccttcaagcgggcgcatgccatcgcaagccatgcgtgactcgcgcacgtcgttattcgtcatcgcgaaacctcgggtcgtatttttcaccgggcgaaaccgtgaaaaagccgattcggcttttgccgcgtgccaataaacaggatgatccgtccgcactcaggtgcagtcgcgaatcattgtattgagggtttcaatacatcaggcaattcacgcaatatattttgatttttatcaaaatcgctttttaatcaaataattacgatggaatgtttcttccagaaggggctggttcatcgatatgtcattcaatcgtgaacggaagcgccgtgccgtttctgctgtaaaacggccgctttgacgggtaacgccggcagccataacgacgctacggtgaattccggaacgtgcacgacggaagcaaacgccggccgcatccgcaccggcccgcgttcgcccatcctccctcgcttacacgcgccgcaacggccggaacccggcacgcacttcacgcgcgaacaactccggctcctcccatgccgcgaaatgcccgcccttgtcgacttcgttgaagtagatcaggttgtgatagctgcgctcggcccagctgcgcggcgcctggtagatctcgcccggaaacaccgtgatcgcggccggcaacgcgatatccaccgcgttgaagttgttcgagtgatcctcccagtagatctgcgcggcggatgtcgcggtgttggtcagccagtacagcgagatgtcgtcgagaatctcgtcgcgcgggatcgaacgctcgggcacgccgccgctataagtccactgcgaaatcttgtcgtacatccatgcggcctgcccggacggcgaatcggcgagtgcatagccgaccgtctgcgggcgcgtgaccatcatcgccgagtaaccgcagttgtcgcgatagaacgtcgcgagcttctcgtacgcggccttctccttcggcgacagcgacgccggcgcgggtgcatcggtcgcgagcagcgtcgcgatatccggcggcaccgtcgccggcatgttcacgtgaatcccggccaggccctgcacgcgctgcatcgccatccggtgcgagatcaccgagccgcagtcgccgccctgcgacacgaagcgcgtataaccgagccgtgccatcagctcgccccacgcgcgcgcgatgtggtcggaaccccagccggtctgcgtcggccggcccgagaagccgaagcccggcaacgacggcacgacgacatggaacgcatcgtcggcgctcgcgccgtgcgcggtcgggtcggtcagcgggccgatcgccttcagcagctcgaagatcgaacccggccagccgtgcgtcatgatcatcggcatcgcgttctcgtgccgcgagcgcacgtggatgaaatgaatgtcgagcccgtcgatttccgtgatgaacatcgggaaaccgttcaggcgcgcctcgcccttgcgccagtcgtaatcggtgccccagtagcgcagcagtgcctgcatgcgcgccagccgcacaccctgcgattcgtcggcgacggtctcgcggcccggccagcgtgttgccgcgatgcggcggcgcaggtcggcgacggcttcgtcaggaatgtgcgcggtgaacgggcgtatgccgctcgcgccggtcgcggcatgcagcgccgtgggcagcatcgccgagaccccggcggccacggacgtggcaagcaggtggcgacgcatcggggaaaacggtgtggaagacatcgttcggcatctcctttcgtgaagtggaaagtgaacatgccgcgcgcgggccgcgccttcgctttcaatccggcgcgcccggctcacgcggcgtcgcccatttgaaaggtctgatgtatcccggatttgtctggcttgtacgcgtttgtagcgactgcgcggcgagcggcacggccggtgcggccgctcgcccgcgcgacgcttacagcgccttgacgatcgcgccgtcgacgcgaatgttctgcccggtgatgtagcccgcgccgtcggacagcaggaacgcgaccgtcttcgcgatctcgccggtcttgccgaagcggccggccgggatgcgtgcgacgatctccggcgtttccggccagctgtcgatgaagcccggcagcaccgcgttcatgcggatgtgctcggccgcgtaacgttccgcgtaaagacgcgtccatgcgctcagcgccgcgcgcagtgccgacgaaacgggcatcggctgctcgggcgcgtccgccgcgaagctcgagatgttgaccaccgcgccgccgccctgcttctggaagaccggcgtcacacggcgcatcacgcgcaccacgttcagcaggatcaggtcgagcccggcatgccagttgtcgtcggtgatcgccagcagctcgcccttcggcggatgcccggtgttgttcacgaccgcatcgatgcggccgtagcgcgcgagcgtttcctgcacgagccggtcgatgtcggcttcttccgtcaccgagccctggatgccgaacccgcccagttcctcgccgagcgccaccgcgctgcccgacggcgacatcagcgcgacgcgatagcccgtcgccgccagttcgcgcgcgatcgccgcgcccatgcccttgcccgccgccgtgatcaacgccactttttctacagtcacgatctgctcctcattcgaatcctgccaccgcgcaaccgccgttcggtgcgccatggtggtaatgtaggcgcatcgatacccactgtcgaaccagtatttctgcctccagccgatagtttttctacagtctgacgatgccgcctcgcccctcccgcctgccgccgctgaatgcgctccgcgcgttcgaagtgtccgcgcggcacctcaatttccgcgccgccgccgacgagatcggcgtcacgcagggcgccgtcgcgcagcaagtgcgccacctcgaggacgtgctcggcctgaagctgttcgaacgcctgccgcgcggcctcgcgctgacgcacgacggcgccgcgtatttctccgacgtccagcgcgcgctgcacgcgatcgccgacgcgaccgacaagctcgtgaagcggcgcgccgcgctgaccatcagcacgacgccgtcgttcgcgtcgaagtggctgatcccgcggctcgcgcagttcaccgacgcacatcccgactacgacgtgcgcgtgatcgccgacccgcagatcgcgacgttccgccacgacggcgtcgatctcgcgatccgttacggcaagccgccgttcggcaagcatctcgccacgcatgcgctgttcccgctcgacgtgtgtgccgtgtgcagccccgcgctgctggccgcgccggcgtcgccgcgcgcgcttgcaagccacgtgctgctgcacgacgcgcacgacctgtggcccgagttcctcgccgcgatgccggagcccgtcgacctcgatccgcacaaggggctgcgcttcaaccagacgtcgctcgcgatcgatgcggccgtcgccggccagggcatcgcgctcgccaccgatccgctcgtcgagcgcgacatcgccgccggccggctgtgcaagccgttcgatttcgcgtttccgctgtcgatggggttctatctcgtgtatccggccgaacggcgcgatgacgacgccatcgtcgtaatgcgcgagtggatgaccgcgcaggcggcgtcggacgggcggccgcccgactcgccgggtagccgcggcgcgggaatcagcgcttaggcgccgtgtgcgatcccgggcagccggcggccaaccccgcaacgggcgatatgccgcgaggagatgatccgatgggatgggaagaaagatacggcggcatctggacgggcgtgctgatgcccggcgagcaacccgttgccgaaatgcatctcgccgatcggcatctggtcacgctgattgcgcaacggcccgatggcctgtatcgggccgtcgtcctcgggcatcatcccgatccgcagtggcgtctgccgttctggggagaagtcatcgcgcccgcgatcgtcgggtcgatcgatgacggggagcagtacctcgccgcggcgttggcccgtcacgtcgaaagcggcgcgtgagcagtccggctcagggcgcgacccaccggccttcgtagccgccttcatgcaggtcgaacaccgcgcggcgatggccggcgcgcgcgagttcgagccagtcgatgcgcgtcacgctcacgtgaagcaggcagaagttctcgtaaccgtcgtcgtcgggattggcgcgcgggctcgccgacacatgcgcggcctcaggcgactcgaccggcgtacccggcggcaacggtgcgcgatacagcagcagcgtatgcgggcggctcgattgccagatcgcgcggcgttgcgcttcgtcgtcgcagatcgatgcaacgccctccgcgcgaatctgcacaagcgcatcgagatcgctggcgacgagcgcgatgcgcggatcgcggcgcagctccgcgaccttctccgagcgcgcatcggtatgaaacgacagcacacgatcggcacggctcacctgacgcaacacgatcgtgcgtaccttcggcgcgccgtcgataccgagcgtcgcggcctgcagcatcgtgaacggcgaacgcagcgcgctcacgccggattcgaggcaggaccagaggcgctcgtacgtttgcgcgagcgattcggaagttgagtcggacatggcgaagcggcgatcgtgcgtgttgcggtcgcgcaagcttaaccgcttgcggcggcgccggcacgcgtgccgcacgccggccgtcgccgtgcggctcagttgtagccgaggacgaccggcgccgcgtcgccgatgtcgtccgccggctgtgcgccgaagcggccgagcacgtcggccacatactgcggccctgcgctgatctgcgacgagcggtgcgccacgggccggttatcgcccgcgcccggtgctgcgcccatcgatacggtgtcgttgacggtgatattcacgttgttgtctcctcacgcggcgagcgccgctccatacgcgcgcacgaggcgcgcgacgccttcccggatcgcatcgacgtccggcgcggcgaacgacaggcgcagcgatgcggcgtcgacgttgtccgcgaagaacgccttgcccggcacgaacacgatcttgttcgcgatcgcctgttgcagcagcacgtccgacgacaccgcgccgatccgcgcccacacgaacatcccgccttcgggacgatgaaattcgatcgcatcgccgaggccgtcgcgcaatgcgtcgcacatcgcatcgcatttgcgctggtacgcggccgtgatgcgcggcaaatgacgttcgagcgcgccgtcggccagatattcggcggcggtcgcctgcgtccacggcgtgctgcacaggtcgaccgtctgcttcgcgatcacgcagcggcgcgcgatctcggccggcgcgatcgtccagcccacgcgcagccccggcgcgacgatcttcgacaggctcgcgaaatgcacgatccagtcgcgtgcgccgtccacttcgtcggccagcgcaagcatcgacggcacggcttcgcccgcgaaacgcaggtcgccgtacggatcgtcctcgacgatcaggaagcggtattgcaccgcgagacgcagcagcttcagccgtcgttcgcgcgtgagcgtcgcgcccgtcgggttcgcgaaggtcgggaccgtgtagagcagcttcggctgcgcgatcgcgccggatgaaagctgttcgccgagacgatcgacgtcgagccccgcgccgtcgaccggaatcgtcacgatgcgcgcctgttgcagacgcatcgcttgcagcgtcgccggataggccggctgttcggtcagcacgacgtcgccgggcgacaccatcacgcgcagcaacaggtcgagcccctgctgcgaaccggtcgtgacgagcagctctgccgccgtgcacgccacaccgcgacgcgccatcaacgcgatcagttgctgcttcagttcggcgaggccatcggtcgggccgtattgcaggcagcgcaccggctgcgcatacgcgcgcccggcggccgcgttcaggccgtcgacgtcgaacaggtcgctggccggatagccgcccgcgaaggaaatcatgcccggttcggacaggtacttgaacagttcgcggatcggcgagccggcgggattctggaatgaaggggtgaacgcgtacatgtcgtcgtgagctggatggtgcggacggccgggatagccgccaggtaccggccaccgcggtgcttctggcgccacggcggcgaaatcgagccacgattgtcgatagtcattaaggccgcggcaaacgatatctatgcactaggtcttgcggtttggtcatcaaatggggcgtggggcgggagcagcaaatccatggccggcaccgggtgccgggcacgctttgccgccggaaagccaatccgcccgattgtttcgccgcccgctcccttgcccccggttcgccggaaccgggccgaatcagtgcgccgtgcccaccggcacggccggcggcggcttcggcttccacgtcgagagcgtgcgcgtgaggtcgtccgacacatagtgcggaccatcgaacaggtagaccggataaccgcgatacgccagcagttgcttgcccagctcgtcggcgctggccgaacggaatccgccccgctcggcaggcctgaacgcctcggcgatgacccgcacgcgtttttcccaactttgcaaccagttcgtcgaggtaggcgcgcgcgacatacggctcgcgggcatagacaccgcagccgtcctggaagaacacgccgacgtccgcgggcagccacgccgcgagccagtccgcgagcgcctttccaccgatgttggtctggtcgtacacgctcacccagagcggccgcggcagccgttgcaggacggcggcgagctttggcgcgtcctgccaggtcggatcgatctcgaccgggaagtagtagccggcgacatgcagcggaaccggtgcgcgcgccacttccagcgactgatcggcgagcgtcgacagatgggtgcgcgcccgtttttcgtcctggtagccggccagccccaggatgacgttcctggcccacggctcacgaccgatgcgctcccagtcgggaagatgcgcggcaggctggatcgaggtgctggcgatgaacgcggtatcgtcgacgacggtccattgaatcagcagatcgtgaatgccgagcatctgccagttgccgaccggattcgtcgtcgagttgtccacctgccagacgatgccgtccgcgtgcacgtcgtgcgcggtccagctgcaggcggccacgacgagcgaggcgccgatcgccgcgagcgtcgccgcccggggcgaacgcggcgcgacaggaagcgggcctggtcgaactgcgagccgaagccggcccatacgccgttgaatcctgcgccaggccgggatcgcgtatggggtcatcgctggctctccggaagcatgcctgcgcgtcatcgtagccgatcgaacgcaaacatgcgacccgccttgccgatgcgggtcgcacggggctgtcgttccgcctgcgtcacttggccgtcgtgccgtccacccacttgtagccgagattcgtaatgccggtaatcatgctctggaagtcctggagcgccggcaatccgagatccggttcaagccagtacggatggaagaagaacgacgcgaaaccgtcgcgtaccgccaggccatactgggcattggtcacgatttgctgccacgtgtatgtgatgcacgagaacgggtcgacattgcagatgttgtactgcacgctgcccaggttctccggaacgatccgctgcccgtagtaatcggcgttgatgatgtacgggaaaaactgtccggccgaaaagtcctggttggcggcacccgttccgagttgcggcttggtcgacgtgtagtacacggcccgctggaacgtggtcgggaacgtgagggctgtcgccgacgatgcggccggcgacatctggtactgcggcgcggcccagccgacgatcttgtagccgttgagcgtgaactcgagcaggccgtcggccatcctgccttccgcccacgggatggagtcctcatcaaccggccggttctgcaccgcgtaccagaactcgtagtcgctgccgctgactgcgttcagcaggttcggcgtcgaatcgtactggtgcgtataaccgtgcatcacgatcgagccgccgcgcgcgagcgcgtagttcagtgccctcttgaggccggttgcctgcgccagatggatcgtctccggcacgccgccgttgtaatagccgttcgggtccgtatacaacgggatggttgccatcgtgaacggaatgtgcttcgagtacatgtaattcgtcagctgctgcatcgaactcgtcgtcgtatacgcgtcgaggtcttccagacggacgagcgcacggtgattcaccggtgcattggtctgcaggatgtcgtgcaggatgtcgcagatcaccaggtagcgatccgtcgggccgatgtaggaaaacggcatgtccgcgaagtaccagaagttgcccgaacgcatgatgtagggcgcggttgccccgctctggctgttcttgatggtgacgagcgcctgcgccttggtggaatcgacgacctgggtcaatccgatgtccggatccgcgctgatgacgcccgtcgacgcgttataggcgtagtacttgaccatcgacaggttcttgtacgtgaccgtatcgtagaagcccggattcggattgctcgccgacggcgtcgcgttcatccccgcgaggcccacgaagctgaacccgaaggtctgattgaacgtgaaggccgtgttccaggccagttgccacaagttgtacttgaaccagaccaccgtcttcttggtggtcatcacgtcgctcatgaacgccgtcggaatcgggttgttgtagtagtcgccgatatagaacgtgacgtcgtggctcccgaccatgccggacgtgtagttctggatcggaaccagatcgatcgtcgcattgaaatggccaagcaggtttctcagcatgatgctgtacatcaggccgagcttcgaatacgggttgttggccgggttgtcgtacagcacgagcgtatgcgctgtggtggcctgcgcgtgcgcggtgcccggcaatgtcatttgcgcgagccccgctagcagggcgatgacgagcaagatctttttcatggccgtttctccctagtcacgttgcacattgccgttgagtttcttgacggaattcttgctgaacttcgggcgccccgtttccttgtatgccttctcccaatcctcgtcggacatccctgctttcacgttgacctgggccgagccgttcggcagcggaggcggcttgatgttcgtgacggaagcgttgcctgtcgcctgcgcattcgcatcctgaacgccgacggcgacggcgaacgtggtgatcaatgcgacgagtgatccggcgatgctcaacccgtttcgaaaagattcattgcgatgcgaaggcatgattttcatcctttgatatgcaaaataagttcatctcgctcgcgagacgagcatggagaatcaccctccggaatcggggcgccatgtcgttaattttgctgcgcaattgaaaccagacaaataaatccgggaggagatggctttactttcaagctagatccgtaccatcggtcgcaaatgggcatgcgccaagggaatgaaattcacgcatcgacgccactcgaaaattgggccgataaaacgtttcaggcatgcaacgcggcggtgtcatgaatttaatcggacaaacgcgcgaaccctgttcgtacgattcaggaaaaccagtcaatcgccgagcttcgcggagcgcaacgcgaaaatttcctccggtgacatgcatgtgcaatgacgactgaagcaccggctttccggttcgacgccggtttatccggctggtcaccgccggaatcgtgtggcgatttcccgaaagcgacgatcggggcccggcagagggtcggaaaacgatgtgtcatccggtcgatcgacggcgtgtttcagcactgaaacatttggctcggattcggcaggccaatcccgtgcggccccctgcgacgcacgtaacgtcaagggtcgcgcagcgatggcgcacgacttgctacatgagctgtgtgctgcggagtcggtgcgcgggggcactgcgcaagcgtcgggtggagagcggcggcaggcgatcaggaatgcagggacggaggcaggcaagcgggaaacgggctgtcaaaaagtcatccactgaacacgttgcatcgttcgcgatgcaacgtgaccacatcgagaaagctcgcgtgctgccggctttttcgagcggagggaattcgcgcggcgcaagccacggagtggacgtgacggggccggcgaggacggggaactttcgtctttcgtcgatacgagggaaataatcaaatacaagataaaagcgcggaaaaatgatggataacatgatttggagtgcgtacttatacgcacttaaccttgtcgccattgtgaccgcaattgtcatcctggtaagcacactggatgacctcacgctggatgcctgttactggtcgtttgaaatccggcgcatcctgcgtcgtgaaaatcgcaaacgatcgatatcggcatgctgcgcgcgctggaagaacggcatctggcgctgatggtaccggcctggaaggaatacgacgtgatcgccaagatgatcgaaaacaccttggcgaccctcgagtacgagcgctacgtgatattcgtcggcacctatcacaacgatgccgaaaccacggccgaggtcgaacgcatggtccgccggtacccgggcagggtcacgcgcgcgaccgtcatgaacgacgggccgacctgcaaggcggactgcctgaactggatcgtcgaagcgatcctgcgctacgaagcggtccaccgaattcaattcgcgggcgtcgtcatgcacgactgcgaggacgtcattcatccggtcgaactcaagtatctcaaccacgcggtcgcggatagcgacctggtccagcttcccgtgctgtccttgccgcgaaaatggaacgagttcgtcgccggatgctacctggacgacttcagcgaaacgcaccagaaggacgtgccggttcgggcccgcctgaccggcatcgtcccgggcgcgggcgttgcgtcgtgctacagcaggcgctcgatcgaagcggcgatgaaggaacgcaacggcgcgccgttcaacaccagttcgctgaccgaggattacgacttcagcttccggttgcgagacctggggatgaaggaaacctttgcatgcattccattgacgggcatcacgcgcgatgcagcggaaagacgcgcaacgggtagcgtcgccgatcgaaacctgctggccacgcgcgagtattttccgaaaacatttcgtaccgcgtaccgtcagcgcacgcgctggatcctcggcatcgcctttcagggctgggagcaactcggctggaaaggcaatcttctcacccgatacatgttcttccacgatcgcaagggcatcgtgacctcgctgttttcggtcattgcctatggcgtgctgatcaacttcctgttgctcggcgcacttcagcgatccatccatgtcatccccgtcggcgccccgctcgtcatggcgagccactgggtcgcgccgctgctgtggatcaacaccgccatgctgttcgcgcgggccgggcagcgtttccacttcgtcagcaagctgaacggcccgacccaggggctgctgtcgatcccgcggatgttcgtcaacaacctgatcaatttctacgcggtttgccgcgcgtggcgcatctatatcggccacctggtgaccggcaagcccatcgcctgggacaagaccagccatacctacctgtcgaacgaagcgctcgggaaagcacgcatgaaagtcggcgagatcctggtcggctggggcgtggtcacgctggagcaattgcaggcgagcctcgataagcagctgacctgcggcaaacggctcggtgaactgctggtcgaaggctgcgcgatatccgccgaatcgctcgcggatgcgatcgccgagcaagccgaactgccccgggtgagcctcggcaatgtcgcggtgggccacttcgcggattcgctggcattcgagctccagtacgcataccacgccgtcccgttttcgaccgcggaagacggcacgttgaacgttgcggtcgggcgaccgctcacgccggacgaacaggacgtcgtgcggcgcggcgcccgatcaaacgtggcctacttcatcgcctgcgatgcggagattgccgccgaactctcccggcactcgcgcttcgtcgaactcgcccgcgtacgcgacggcgacccggcggcgcagcaaggcgccctcgtgacgaaaccgtcgggagaacaggcatgaagcattcgaaacccccgatcgcggccggcctcaagcgctgcgcacggttgagcgcactggcgatcgccgtgtcgctggcgtggcaggcgccggccttcgccgcgcagccgctgacgcccaaagcctaccggctcgccgacagcgcctacaaggcgatcaatgccggcgacctgcccctcgcggaagtgtatgcgtcgcgcgccatcaggattcagcccggtagcgaacagctcgggctgctgctcgtcgacgtatacaggcgggaaggaaaggtcgacgaagcggacgccttggtggaatcgctgacggttcgttttccgaagagtgcggcggtgcgtgcgcagcatggctacctggcgcagcggcagatgcactacgacgtcgcctgcagcgatttctcggccgccgtcgcaaccgggaaatggagcaaggagcagcagcgcaacctgcgtctcgcctggtcggacagcgcgctcgcggcgaatcgtccgcatgaagccggcatcgcgctggcaccgctcgccgatgaaaaatcggccgtggtgcagttgcgcatcgcgcagttgagcctgcaggcgggcgaccgcgataccgcgatccggatggcggatctcgcggccggcgatgcgacgaccgaaggcgagcgcaacatggccgcgtcgatcgcggcgcaggcgcggcaggaagaccagcccgaccaggcgccggtggacaataccgcgcaacagaagttgcaggaagcctatgacctgctgcgcgaccacaaggatcgcgaggcactcgacgcattccaggagggcttcgccggcggcgccggcaacgcgatgaactacgcggacgcgggctacgccgccaagcggatcgggttgaacgacgagtccatcgacctgttcgagcacggcctcgacgccgatgaaaacgaacacaaattcgatgcgcagcacaagttcggctatcgacgggaagtcgagcagcttcagcgcacctggggttcgtgctgagcgcgccgtaccagtcggccgcgttcggcccgcaaggcacgatcagcgtgttgcagccgggtatcgaagcgtattggcagccgccgaagatcggctaccagaacggccgcatcttccagttcttcgtgcgtggatacggcacggcctacgacgggtcgggcaacgtgaccggcatgccgaccgtgcagggttcggtgggcgcgcgctacaagccgctgcccgaccagaacgtcgtgctgaccgccgagcggctgttccacgtcggcagcctgtcgatgacggactggctgatgcgcgtgggttattcgtcggaggccgggaccgacctgcgggtgaccgaaccgagctggcgcagctggcaggcgtatgtcgaaggcgcgtacttcatcagcgcgggccggtacatcatttattcggagttgcgttacgggcacacctggcgtttgccgatgatcagcgatcggctgaccatctacccgcacgccgcggtggccggcgatcacgacaatcgacagccggaaaagacggcgatcggcgccgggcccggcatccagttgcggtactggtttcgcgaagggcggtacagcgcgccggcaagctatctggatgtcacggtgcaataccggttcggattgacgtcagcggcacgcgcacgtggtctcgtggtacgcgcgacattgtggttctaaccaacgacgctgacgcttgctcctggatggcgcttttcgcttagttgggcgccttgagcgtgatgatcgtctgacgcaacagctggaagtacgagctcgtcgaatacgggagcatttgctcggcgtagttccaccagaagaatccgccgatgaaacgcggatcggtcatgctgttgaccatcgggtagtaggtcttgatcaggttctgctgcaccgatgcgggcgcggagatatccgaggtgccgatttcgccgaagccgaccttcgcgttcgggaagatgctttccagcgccgcgaaatcgttcttccacgtcgggttcagccccgggcaatcctgatacgggtagtagctgaacagcgcgtagtcggcctgctggcggaccgtcgaggacaggaacgcagtcggccacgtcttccagtaatcctgcggcttctcccagcagttgttgcccttgctgtcgtcgttgtagtacagcgtgatggccgtcttgccgccgttcgatttgacgatctggttggccgccgcaaccatctggccgatctgctgctcttgcgagttgaccacggaattcgtgccgctcgggttgttacgcagccattcgccgttgatttcgttcgcgatctcccagacgtcgacggtgttcttcagctgcgacaccagttcctgggttcttgccttgtacgtggtgaggtccgtcgggaaatagtaggaatcgtagacttcgcccatcacgtatgcgaccgcgtgcaggcgcagcagaggcgcgtagtagtcggcggccgacgtatccggatcgaacacgacacgcacggtgggcttgtacggcaggttctgcagcgacgcgacgatggcgtccagtttggtcaggtcgtcgagggtcacaccgtagacgggattcttcagaggttcgacctgggcttcggcgggccgggataaaggcatgagcccggcataagcgacgcatgcggcgatggccgtgcgcgagagattttcgtcagtcctttcaaaacgctttccgttataaagtaagaggaagcgcgattttagacgaaaataaaagataattatcggacgatacgcgaagtagcgagccctaaaacttcgttaggattggtatcgaaagcgagctatccggagtgtcgcgacgggtgattgttacgaaatactgattaaatcggcgcggggtgcggagacgcggcagaggcgtccaagggtaaagccgatgtccgggtggttgcttgcaaacgattgcggacatcccgagccggtagcaacggatttcgactgacaagcgcggcagcgtgaagggagccgctcgccagcggtcgcgtcggaacgtccgtcgccagagtcagatcaggcgagtaagtcaaaaccctgatctctcggccagcgtcggatcaggcctgagattgcttcgccgtcacgccaccacgggccgtgatcgacccgaagccgacgtacaccggcacattcgccgatgccgagagcagaagctcaattgaatgttccgatcagaccgtgtaccgaagggtttcgccgaatggcccggacttcacgcgtccgccgagcgtttggccgtgaaccgatcgccgatcgaggagccgaccgggccgctggcacccggcaggcttcgcagacgcgggcgacatcaagctccccaacgcttgaagacgaggctggcgttcacgccgccgaagccgaaaccgttggccatcgcgtgaatgatcggcatgtgccgcggcgcatcgtgcacgatgtccaggccctcggcgagtgcgtccggctgttcgaggttcagcgtcatcgggacgacctgatcgcgcaaggccagggcggtgaagatcgccgctacgccaccggccgcgcccagcaagtggcccgtcgccgacttggtggaggtgatggcgagcgggacgtcgacgccgaacaggtcgcgcaccgcggccaattcgcccaggtcgccgaccggcgtcgaggtcgcgtgagcgttgagatgctgcaggtcggacgcggtcaggccggcctgcgtcagcgccgcctgcatcgagcgtcgcgcgccgctgccgtcttcggggccggaggtaatgtgaaacgcgtcggcgctggtgccatacccaatgagttcgaccagtggagcggcgccgcgcgcaagcgcgtgctcgagcgattcgatcaccagcatgccggcgccttcgcccatcacgaaaccgtcgcgagtctggtcgaagggccgcgatgcgcgggttggcgtgtcattgaagccggtggacaaggtcttcgctgcggcgaaggcgcccaggctgacgcgatcgattgcggcctcggcgccaccgcacaccgcgatgtcggcctcgccgcagcggatcagccgtgccgcgtcgccgatggcctggatgctcgcggcacaagcggtcaccggggcgcccattggccctttcaggccgtgcctgatcgacacgtggcccgcggcaaggttgacgaggaacgaggggatcgtgaatggcgacagacgcttcggtccgcgcatctcggtcgtccgcaccgcgcccgcgatcgccggaaatccaccgatgcccgacgcgatgaccgtggccgtgcgctgccgggacgcttcgtcggccggagcccattgcgcctgcgcgagtgcctcttgcgcggcggcgagcgcgaaggcgatgaagcggtcaatcttgcgctggtccttggtcgacacaaagcggtcgatgtcgaagccgccgcacgcatcctcgtgcacatcgggcaccacaccgcccacgcgggccgcgatgtccgccgtcatcgcatccggcagcaggcgcaagcctgactggccggccagcagccgctgccacaccagctcgactccgcaacccagcggcgagaccattcccatgccggtgacgacgattcggcggttcgcagtgggcgtgatgtgcatggattctgtcctggtcgatctattgatgatgatcgacatcatacagtattgagtatgattgtcatcaacacgcaatgccatgcgcacgaaaggatcttcatgaaagtctcgaaaacgcaggtggccgaaaaccgcctggccatcctgcaggccgcggcccggctgtaccgcgagcgcggtttcaccggcgtggggtggccgacatcacacgcgaggccgggctcacccacggcgggctgtaccggcacttcgaatcgaaggatgcgctggcggccgaggccgcggaatacgcgttcgagtggaaactctccgagctggagacaccggatgccgatgcgaacaccgacgccgacgggttccttcgagctggagtcgcgaattacttgtcgccgcagcatcgcgacagcatcggccaaggctgcccggtggccgcgctcgcggcagacgcggcacgcgaaacgggtgcgatcgcggacgctttcgcccaaggcatcgggcgctacatgacgctattcgcgcagcggaggcccgatggcaccgaggctgcgcagatcgaacccgaggaccgggttcgcgcaatttcgatgctgtcgacaatggtaggcgggttgatcctcgcccgagccaccgcgcggggattgccggcgctatcagacgagattctcgcgaccttgcgcgatcatcttgcggccacatggggcctcgatgaagtcaacgtcgacggacgcgactagaaagcaatcgccgaagggcgaatccccgaaccacaccccgtccggtgaactcgcccccttccggtttccgctcaaacagacgcgttccggttcgcctcgatcaccgtcaacgccgtcatgttcacgatccgccgcaccgtcgcactggacgtcagaatattcaccggcgcgttgacgcccagcaggaacggtcccaccgccacattgctgcccgcctccgtcttgagcaggttgtaagcgatattccccgcatccacgttcgggcacacgagcaggttcgccgcccccttcagcggcgacatcggcagcagcctcgaccgcaagccctcgtcgagcgcacagtcgccatgcatctcgccgtccgcctcgatatcgggcgcctgctcccggatgatctccagcgcccggcgcatcttcacgcccgacgccgcactccccgacccgaagttcgaccgcgacagcaacgccgccttcggcgtgaggttcagccattccatctgacgagccgcggcaatcgtgaattccgcgatctgctcggcatcgggattgtcgttgacgtgcgtgtccaccagcgcgaccgtccgctgatcgagcaacaggatgttcatcgccgcatacgtggacgcacccggcttcctgccgatcacctcgtcgacgaaccgcaggtggttgtgatattcgccgaccgtgccgcaaatcatcccgtccgcatcgccgagccgcaccatcatcgcgccgatcagcgtcagccggcgccgcatctcgacccgcgccatttccttcgagatgccgtcccggcagcgcagctcccaatacgtcgtccagtactgcgggaaccgctcgtcgtactcggggttcgtcacctcgacatcctggccgagccggatccgcaagccgaaccgctcgatgcgcgccagcagcacttccgggcgcccgaccaggatcggacgcgccagcttctcgtcgacgatcacctgcaccgcgcggagcacgcgttcgtcctcgccttcggtgaagacgatccgtgccttgccgccgtcacgcaccagccggcgcgccgtcgcgaacagcggcttcatgaacgcgccggagtggtagacgaattgctgcagttgctcgacatacgcgtcgagatccgtcagcgggcgcttcgccacgccgccttccatcgccgccttcgccacggccggcgcgatacggacgatcaggcgcgggtcgaacggcttcggaatcaggtattgcgcgccgaacgccacgtcgtacgcgccataagccgccgcgacgacttcgttctgctcctcctcggccagccccgcgatcgcgtgcaccgcggcgatctccatttcgcgggtgatcgtcgtcgcgcccacgtccagcgcgccgcggaagatgtacgggaaacagaggacgttgttgacctgattcgggtagtccgagcggcccgtcgcgatgacgacgtcgtcgcgcgtcgcgtgcgccagttccgggaagatttccggcgtgggattggccagcgccagaatcagcgggcgcggcgccatctccttcagcatctcggcactcaggatgccgccgaccgacaggcccaggaacacgtccgcgccgccgatgacgtcggccagcttgcgcgcatcggtttcctgcgcaaagcgcgacttcgccgggtccatcagcgcggtgcgcccgcgatagacgacgccttcgatatcggtcacccagacgttctcgaccggcagcccgaggtcgaccagcaggtccaggcaggccagcgcggcggcccctgcgcccgacgtcacgaccttcacttccgaaatcgacttcccgacgaccttcagcccgttgatgaacgccgcggacacggtgatggcggtgccgtgctgatcgtcatggaagaccggaatcttcatgcgttcgcgcagcttctgctcgaccgtgaagcattcgggcgccttgatgtcctcgaggttgatgccgccgaaggtgggctcgaggcccgcgatgatgtcgaccagcttgtccgggtcggtttcgttgatctcgatgtcgaagacgtcgatccccgcgaacttcttgaagagcacggccttgccttccatgaccggcttggacgcgagcgggccgatgttgccgagacccagcacggccgtgccgttcgtgatcacgccgaccaggttgccgcggctggtgaagcggtgcgcctgcagcggatcggcggcgatggcctcgcacacgcccgccacgcccggcgtgtacgccagcgcgagatcgcgctgcgtcacgagcggcttgctggcgacgaccgagatctttcccggggtcggaaattcgtgatagtcgaacgctgcctgctgctgtgtctcagtctgtttcatgttttcgatccgggcacgggcgccaggccagtcccggcgcgatccatgaaggtgattctagggatccgccataaggtgatgattctgttttaatatcgctccatcactttttcatgatgaatacgtgaccagtcaatgacttttgacgcgaacgacgtggtcaggcggctgggcgcgcgcctgaagatgcggcacctggtgctgttgctgcagatccagcagcacgggtcgctgacgcgcgtcgcggagcacatggccagcagccagccggccgtgacgaacgcgctgtccgagctggagagcatgttcggcacgccgctcttcgagcgctcgtcgcgcggcatgcggcctaccgcgctcggcgcggtcgtgctcgagcgggcgaaggcgatgatcaaggatctcgaccacctcgcccgagaaatggaggccgtcgccgccgggcatgcggcccacctgcacatcggcgtgattccgttcatttccgggcagatgctgtcggcggcgctcaagcggctgcaggcgcgcatggaacggcgcctgaccgtaacgattcacgaaggcaccagcgatcagctcctgctgcagctcaaggaccacagcgtcgacatcgtgatcgggcgggcgtcgtcggcgatcgacctggggcaggtttccttcgaagtgctgtaccagcagcagccgcgcatgatcgcgagccggcgtcttgccgcgaaactggcccgcaccgcgctggactggcacaagctgcacgcgctcgactggattctcggcgccccgcatacgccgatgcgggaacaggtcaccgacctgttcctgtcggccggcatcccgccgcccgttccgatcgtcgaaagctactcgtccaagctgatcggcgagatgatcgcgtcgagcgacgaggccgtatcgatcgtgcccgccgacatcgcggaagaactggtgcggatcgccggcgtggcgatcgtgccgtactcgctggtctggacgctcccgcccatcgcgctctttacccgcgccgccgattcgcgctcgccggcgcgggatctccttgtcgacgcgttgcgcgaggtatgcagggagacttacgggaagcgcagcgatgaggctgcgggcggccgcctgaacggcggttcgccccggcggcaacccacgcgcgtggcggcggaggctcgccgcaccggcagcgcgctacttgctggcggcgaggtgatgcagaatgtccgcacgctcggcgctcaacacatgatccgagccctcgccgcggtcataacgcttcgcggtgcggtaggaaaaccgcttcctgtactgcccgatggcgggatcgaacgtccacgcgtcgacgacgaaaaagtgcttgccgaaatgatcctcgtcgtcggcccacacgaagtccgcccgaacgaacaccggatagggcgacacgtccggcaccttccacatcgcgcgatcggccgtctccgtctgggtgacttccggcatcaggttctcgatcttgccgttcgcgccataacgcaatatcgccacgcgctccagcatcccgctgccaccgccggaaaacatccccgagaagaacacccacgagccgcccgacgcaatcggcagccgctctgaccgcggcatcagtccgaactggtaaagctccttcgacgaatggggaaccggcacgggcggcatctcgaagcacggcgcacgatcggggagcacgcagagtttcacgccggacagcgggagcccgtccgaatcctgccggccctccgcctgggtgaaacgcgggaatgccggttcgctcggggcggcctgcgcacccgcgatgccggcgacggaaatgcccaggatcaccccgagcgacttgacgaccctgcgcatgcacctgccctctctcatgttttgatagccgcgaattgtcgatgatccggccgcttctgtcgaacgggcggttgcggccggcgatgcgcttcgcgccggttcgtcagaccgtcgccagaaccagacgccccggcgacgcaccgatgtgcagcccgtcggcgcgattcgcgagatagcgccggttcaactcgtccggcgtccatgtgttgctgtggctgaagcccagcgcggcgaggctcgcggtcaaggcgtcgggttcgaaaaagcttttccacggctcgccacgctcggcaaatcgcgccgtcatctgctccatcgcgatgcgcatgatcggcggcaggctcgacagcggaaccacatattcgagcaggaccgcgctacctttggcacacccggcgatgaagcgcagcgtgtcgatcaccgcggcctcgtcgagatacatcgtcacgccgagccagctgaacagcgccggcgcatcggcatcgaaaccggcgcgcgccagcccttgcgcgagaccgacccgctcgaaatcgaccggcacgaatcgcagcgacggcggcaccgccatgcccgcctcgcacaaacgggcctgcttccacgcctgcgtcgccggcaggtcgacctcgaacacgcgccccggcgcatcggctcgccggtatgcgctggtatcgagccccgcacccagcaccacatactggcggatgccgcgttcgatcgcgtcggcccacacgtcgtcggcaagccggctgcgtaccaccaccgtgctgcgcatgcccaccgtcattggctggcggaacttgtcgaggttgtcgcgcaaggcttgcgcctcagccgcaccgaggacggtcagcgcgaccggatcgtcgagcaccagcggccggtcgagcagctggtgcgcggcccgctgcgtggccaccagcagcgcgctcggcttgggcccggcgttcatcggcgtcgtgtcctggccgacgacatgcgcccggttcagataagcaagcaacgcatcgtcgaggccgatgcccagttgcagatccggttcgcgcatcatcgcatcgcgcacacgtgcttccagcgccgcgtcgtcgccgcagaagctgtcgagaaacagctgctgccagcgcttgacgatcgcctgcaccggtgcggcgccggcgtcgacgcccgcatccatttgcgctctcagttcgaccaccagcgccggccacgctcgatgcttcatggcggcgaactggcgccgccgcacctcgtcggcctgagtcgggtcgaggtgcttcgcaagtagcgcgcagcgcgcgtgcacgaacgcttcgtcgatccatgccagcatctccgccgtgatgccgacgatttgcggagcacgcggttcgtcgagctgaatggccatcagcttggtcgcgagcgtcgggtcgttgcgggtcatccggaccacgagccggatccagcgccacgccagcgcctgggcggcttcgctgccggccggcagcgcctgctgccgggcaacgcgaacttcttcgatcagcgctgcccacgacggatccgtcggcgcgatcgtatccggcccggatgccagcaacgcatcgagttcgtcgtcttcaaggtgtttttggatcatgttcatccactccagagcattcagccagtcggtcgccgtggtctcgtcgccggtggcgatcacgtccacgatgtattgcaggtgacgactcaggcgctgcgcgcgcgacgcctgtgcatcgagttccgcgatctggcgctgcagaagctggagcggtgaaccggccagttggccgtcgaggctcgccttgatgtccggcagcgaatacccgaagcgtttcagcgcctcgatccgatgcagccggatgaggtcgtcccgcccatacaggcgcgcgccgccgtccgtgcgccgcgccggcgacaacagcccgattgcatcgtagtggtgcaaggcccggacgctcagtcccgccttcttcgccagatcgccgatcttcagtcgcatttttccccggtcgtcggtgtcgaccataaaagctgacgtagcgtcaggtgcaagggaaatcgaaggggcgtatccagttgaacgccaagcagcgggtttctcgtacagcgaccagacaatcccgtccgatttcaaccccacgcgaatgaagccaagcgactcgtagtaagcgcagagcgtcacgttttcgacggcgcaatcgagccggacaaaatgccggttcaagctgctcaccttgcgagcgcaccagtcgagcatgaaaccgccgagcccgagcccgttgaagcctcgccgcacgcaaagcccgtgcacgtaaccggcgatcggcgcctgcggccccaatgccggtcttcgccgaagccgagcgagaacgttccggccaacgcgccgtccagctcgacgacatacacgtccttttcagcaacgttgctccgtacccaccgctcggaaaatccgtcaccttccttgccccacacatggtcgccgtacgtgagcttcttcgcgtgcgcgtcgttccggatccgggtcagcgccggtacgtcgtctgccgttgccctgcggatgtttttcgaggtcatcgcccgtttctccgtggcgtcttcacgtcacggctcgacagccgtcatcccgccaagccgtattttcgacagcgggcactcgcccggtcagccgaaggcacgacgctctcatgaagctgtcgcctggaaccagcgcgtacacgggcccgtgtaaatgagcacggttgcgatcgcattggcgagaaagcccacttcgatcaggctcagcctgaaagggagccccatcacgagaagggccatcgtcgtgacgaccgtgagccccagttccagcacacgcgccagcttttgtcgctggcagaggcccacgatcaggctcgcgttcagcaaaagccagaaggcctggatgatcccgatcatcgcagcgcctttgcgcatgagcacggctttcgccgcggggacttcgccagcctgatcgaaacccagcatcgtgagccagacggcgaatccggcctcgatgagccagacgatcgtgaagagcgcgatggcgtgacggatctgcaacggtgcgtcggcgcgaaacgccggcatggccttcaacttgccgattggcatcgtctctttcaggaagcttgcgctcccgccccggattgtgttcgtatcgtatttgccgcttgtcgatttcacgacgcagcgagtttcggccgagtgtagtccatccgcaatcgccacagacgcgtacgcgcacgcacgccgaacacgcctctagtgcgaagcattcaagccctgccggagagcctcatagatccccacgccggcatcaacgatgaacaggagtgcaatggcgacgcacgcaacgcgcccgataccgcgcagacgcgtcacgccgacatacagcccgacagcgccgacgcaaagcgtcacgggccagtagatggcccccatgagaatcgcgatgacgggaaaaggcaggtcaatggcgatgtcactcatcccggaaagctccgttgctcgcatgaagcatgcgttcgctcatcgattcgacggcatcggtcgaccgccgtccatccgcgcatgacattgcaagccgcctcgccgccccatgctgcccgacagggcatcacccctgcgcctgatgacacaccacctcgatattgtgcccatccggcccgatgacaaatgccgcgtagtagttcgcgtgataatgcggccgcagccccggcgcgccattgtccttcccgcccgcctccagcgccgcgcgatagaacgcatcgacctgctgccggtcgtcggccacgaacgcgatgtgaagatgcgccggcttctccgacgtctggaacaggcacaacgatggtttgccaggcggggacatctcgatgccgtacgacggatcgccctcacccaccaccacgacgccaagcggttcaagtgcgctgaggaaaaacgtcttgctggctgcaaagtcgctcacgccgaatttgacatggtcaaacatgactcccccttcggatggatgggtctgccggcacccggatcggatgtgcaaatcaccgcgatgttgccacatgcagcgatcggtggcacacctgcccgccctcgaacaaaaagcccgacacggtcgggccaacgagcgagatacaaggagaatcccgctccccctcatcgagcggtcacaccacgctgcctgacgtcatcatgatccgggcaatagccgacgatcacacacgacgttgcgaccgattgtcgatcgtcaggcttccatgaaagggttcggaaagaatggctattgcgaaacggggtgccggatgacgcattcgccggcagggtcgggagcggaacggccggtggcgctcacccgaaaaattggcccgcacctgaaaacctgaaagcgcgggccaagccgagaacacacaacaccttgggggtatcaaggcgagaccagtctagcccgagtcgccggaaagaaaatttcaggccacattacagctattactccatataacgaagcatcggccgccgccgtgtgcgggccaaggggcgacacatcgtccgcgagcgcgtgcggcattacggcgtgccgttcgccggtgttgcttcgggcgggcgacggatgtagtcgtgcatcggaatgccttgccgccttcccctcaaacgccggcaccatcgaagctggcggtatcgccattcgcgcaagccgcggacaccgcactcacgcgctgcaaccggtcaggtcagcgcgcgccggacagatgcagcgtgaaccactccaccgccgcccggctcgtttcgtcgaaatgctcgagatacggcgtgaaatgcccgcccttgatctggagcaggcgcttcggctccagcgcgttttcccacgccttgaggcacaggtcggtcggcgtcagcaggtcctcgttggctacgatcatcagcaacggggttggcgagatgcggtcgacatactggcccggttcgttctcgcgcgacatctcggcgctgcgcagcgtcacttcgtttttccagttcggcgcgcaccgcgccgccgactcggtgaagaaccggtacgcatccgcgcccgccatcgcgcaggctgtcgcggggtccgcgctgactgccggcaacatcgccggcacgccgccggcgaatcgctgccgacgatcttcatcgaagcgagccagcgccgcgggcaccagatcggaacgcgtgcggcgcaacgccgactgatatccgctgatcgtcggcacctgcgaaaccacgcatttgacgcgccggtcgatggccgcgacttcgagcacgtggccgccgctgtagctggtgccccagatgccgatgcgggcggcatcgacgtccgggcgcgtcagcagatagctgatcgcatcgcgatagccgcgcttctgctgcacggggtcgatctcctgacgcggatacccgtcgctcgcgccgaaattccggtgatcgtagagcagcacgccaaagccgccggcggcaaatacctcggcgtagcggtccagatactgttccttcacgccggagaagccgtgcgccatcacgatggccggatacgcctccgtaccggcgatgcgctgcgccggttcgtagtaccagcctcgcagcgtggcggcttcggacaggaattcgatgtcgtgtcgcgtcatgtcggcttgcctcgttcggtcagtggattcgatgaccgacacgataagcgtgcacgccgcgccccgcgtttgctggaaggacgtttgctacgcggaatcggacagtttcgcgtacgcgctgggcgtcatgccggcaaaccggcgaaacacggtcgagaaggcgctcgtggtttcgtagccgagttcggccgcgacggcgatcacggagcgccccgaggccagcagcgggcgcgcggccgaaatcctggcctgctggcgccactggctgaacgacagcccggtttcggcggtgaacagccgggccagtgtccggctcgacgcaccgacttcgtcggcccattccgtcagcgttcgctgatcggccggattcgcgagcatcgcgtcgcagacccgggcgagacgccggtcctggccggacggcagccgcaacggttgctcgggagaccactcgatttcggcgagcatgagctggatgacgagcgcgtcgcgtccgtcgggatcgacctcgaccgggaacgacgatgcacgcacgatcaactcgcgcagcagcggcgaaacgttgaccaggcccggctgatccgggtacgcggatcggcaggctcgcgggtcgacgtaggcggtgcgcatttcgagttgcccgtgtgcgcgcatcgcgtgcggcaggtcgggcggaatccagagtgcgcggtgcggcgggatcatccacagcgaccggcaggcgatgacttcggcgatgcctgtcgtggtgtagacgagttgcgcgcgcgtgtgccgatgctccgcgacgacgaagccgtcgggaaatgctttcggcatgacggccgcgatggcgggtgcattctggtagtcgcgcgggtcggtactcttcgtgacgggtgcgatgccggcccgcttcggatccgccgcctcgccgtgcccgatcgctttaccgtggccgcgcctttcgaccttcatcgctcgtcctttcatgtgtgcggaatcgccggcgcgtgggacccggcgaaccggacggatgatacgggaatgtcggaatgaagcagcaaatcggcaccccgatctcaccgctgtagcgcaaactcgacaagcagcgccggacttccgatgtcgacagtttcagcagcatgccgcacgaccttggaagttcgattccgtgctgctatcgttgtgcacgcaattaattttccggagcagccgatacatgcccttgatcttgcgccgagcgacggcggctgatgccgcggaggtggctgacgtgtatctgcggtcgcgcaacgcgctcgcatcctacgcgccgctcgcgcactccgaagccgccgtccgcgactggattgcctacgtacttgtcccgtcgggcaacgtgaccgttgccatgtacgacgatcgcatcgtcggcatggccgcacacgtcatcgctgacggtgcggcatggctcgaccagttgtacgtgtgccccgaattcaaacgacaagggatcggttccgccctcctggaatcggtgaagtcgcagacggttggcaagctccagctctatacgttccagatgaatcgcgatgcggccgcgttttatgagcggcatggtttcgttgccattgcatataacgacggaagcaggaacgaggaaggttgtcccgatgtgttgtattgcctgacgcggtagcttccgtccgcatgctccacgtcgccggtccgtcaattgccggctggctttcctggcattttcgtcgcataaagcggcgccctggccatcggctcatgcgtcccgcacacacaagaacgaaccggctcccgatgcgccacaggccgctggtccaatatatgattcatcaccattcagccgcttcaggtcgaacgaatgcccaacttccccggatcttcgccagtggtattacttcgcggccgttgccgaggagcggcacttcggccgtgcggccgcacgcctctcgatgacccagccgccgctgtcgcaggcaatacgctccctggaacgcgaactcggcgtcgagctcttcgcacgcacgaagcgtgcggtcgcgctcacggcagtcggcgaggcgttgcttccgacggtgctgaaactgcttgccgcggccgaggagcttcccgcgctggcaaagagcctcgctctcggcgagaccggaagattgtcgctcgcgttcgtctcgattgctgattacgggctgctgccctcgctgctgcgcgaattcggcatgcgctatccgctcgtgcgattgcaactgaccgaagcgacgagcgacgtgcaaatcgaagagctggtcgcgggccacatcgacgcgggcctgatcattccgccgttgccgccgcgctacgtggccgagctgtcgtatctgccgctcctgagcgagccgctcgtgctcgcgatgccgagcgccgcgtcgacggcacccgacgacgtgccgattcacctgaaggaagtggcagaccttccgctcgtgatttttccgcgccgtctcgccccgaggttttacgacgcgatcatggagtgctacagcgacgtcggtgtcgtcccgcacatcggtcaggaagcaatccagatgcagacgatcgtcagccttgtgtccgccggcatgggcgtcgccctggtgccgcaatcgttgcgcaatctgcggcgtacgggtgtcgtctatcgcccgctcgcacacggctcgttcgtcgttgaaaccggcctcgtctggcgcaaaggcgatatcgggcacgtccttgccagcttcatcaatatcgtgcggacactggcctcggcatgacgccggccgcaggcagatccgctttggcatgcccgggcggcttggcaggccacttgccgtgcgacgacgcgcgggaagccatcgacgcacggccggcgcgtcctcgccggcggacgcaccggccgacactcacgccttgccgtgcccctgcgatcccgggcccgacgagaattcgcggacaccatcgcgattgatgccgaagccgaggcccggcgtgtcgggcagtgccagcgtcccgttctgctcggccggcaggccggtaaacaggttccggcagatctcgaccgcgacgacgtgccactcgaccgagccgccgttcgcgagcccgccgtgcagatgcatgttgtggaacgggaacgtgccaccgttgtcgatcggcacgccgaacgcctgcgcgagcgcggccgcgcgcgccgccatggagaacccgccgcacacgcacacgtttggctgcaggatgtcgacggcgtcgttcacgaggaaatccctgaaccggaacaactgcccctcgctttgcccggtggcgaccggaatgccgccgcgctttctcaggtcggcgagcttcgcggggtcgttctcggcgatcggctcctcgaagaaaccgatgtcgcaatcggccacgcgctcggcaagccgcagcgcgtgatagtggtcgagcccgcaattcgcgtcgatgtaaatctcggcggcatcgcccaccgcatcgcgcaccgcgcgcacgcgcgcgacgtcgtccgcgacgacctgatcgagcgagcgcccttcgtcgcggcgcgcaagcgcgtgatagccgacgatcatcttgatgcggcgatgtccggcgccgacgagcgcacgcgcggcatgtatcagctccgggcgctcgagcgacgcgaagccgaacgtcgtgtacagcggcacgaccggacgcgcgccaccgagcattttccataccggcagcccggcgatcttgccgatcgcatcccagaccgcgatgtcgatcgcggaaatcacgtgccccgcatagccggtctgcccgcgcgggcataacaaccagtaaagcttgtcgagaatccgctcgcgctcgacgacgttcatcccgaccaggttgggtgcggcgacgtgatcgatcgccgcggccacgaccgcttcgtcggtgatcgccgtgaagccgtggccgaccacgccctgcgacgtctcgatttcgacgacgacgcccgacagcttgccggacaaccgcacgccggcgatctccgcgtcgccgcgcgcgaacaccggcgtcgcggtcactttcacgatgttgtgctgcatctcttctccgtttttaagggaatcgcagaactgcggtggccgcgtcgtcgcgcggcatcaccggcccttctcgcgacgcagcacgaacgtcagcccgatgccggtcagcaggccccagaacgcgccgccgatgccgagaaacgcatggcccgccatcgtcacgaggaaggtcaggatcgcggcctcgcgcgcgtccttgtcggtgaatgcgttgagcagcgcgccgccgagggcgttcatcagcgcgaggccggcaaccgcttcgatgatgaccggcggcgcgaccgcgatgaacagcgtcgcggcgctcgccgcgaacccgtacacgatgtacgcggcaccgcagacgatgccggcccagtagcgccgcgattcgtcggggccggcttcctcgccggcgcacagtgcggcggtgatcgcggcaaggccgatcggcggcgcgccgaaaggcgccgcgagcaggctgcacagccccgtggccgtgaacagccgcgacgcttcaggccggtagccgttgacgttgagcaccgcgacgcccgggatgttctgcgacgccatcgtcacgatgaagagcggcaccgcgacgctcaccatcgtcgatgccgagaacacgggcccgacgagcgcgaggtgcggcaacatcccggtcgcgccgacgcccccgtcttcgcgatgaacgcgatcacgatcagcgtcgcgaccgcagcgcaaggcaccgcgagaatcttgcggacccgcatcatcacgacccagacgagcaggatcggcgcgacgtacagcggatactgctcgagtgcgtgcaccggggcgacgcagaggttcaggatgatccccgcgagcatcgcgttggcgatcggcagcggaatcctcgagatcgcgcggccgagcggcttccacagcccggccagcgtgagcagcacgccggtcagcacgagcgcgccgaccgcggccggatagccgcccttcacggcgcccaggccgagcagcagcgcggcgccgggcgtcgaccacgcagcgctgacgggcatccgggtccggtagctgagcacgatgccggccagccccatcacgatcgagacggccatcaggccggacgcggcctgcgcgcgcgttgcaccgacgttcgtcagcgcattcacgatcagcgtgaacgtcgatgcaaagccgacgaacgacgccagcgcgcccgcgccggccgcccgcgccgagaacccgcgatcggtcttcatttccgcgatactgctcatctgtcctccgtgagatggattcgatacggcggcgaccgtatcagtgcgcgccatgtgtcggctcgccgcactcctggttcagcgttcccgcgtgatacgcggcgagaaacgcgtcgaagttgccgatctgcgtgcgctccaggtcggcctgccggctcagcgattcggccgcggtcgcgtcgaagcgcgcctgcacgtcggccggcagcggacgcgcgcggaacgccccggtatgcgcgagcgtctgccgcatcccgaacgcgaagcacgcgccgcccggatcgtcgcgcagcgtgtgcagtgcatcgagtacgcgcgccgacggcgtcgcctgcggatcgtcgagcttcgcgtattgcgcgtcgagcgcggcggtcgtgcgcgtgtcgccgcgctgcagatccagcacgccggccgcctcgttgattcgcgcgagcaactcgcgcgcccacgtgcgcagcgcgacgcgctcgccgccacgctgcaactccagccccgggcgccgccctcccgcgcgaccgccgcgaagttgcgccggcacacggcctgctcggcacctgcgaggcaggggctgtcgtcgagcgcgcagaacagcaggaacgcgtcgacaaagcgcagcgtcgtctcggcgacgccgtgcggcgcgaacggatcgatgtcgagacagcgcacctcgacgtattcgacgccgcggctgcgcagtgcatcgatcggccgctcgccgctgcgcaccgtgcgcttcgggcggatcgacgagtagaactcgttctccatctgcagcaagtgcgtgctgagctgcaaccattctccgtcgcgcttcgcgccgatcgcctggtactcggggcacggctgcgcgacggctcgcgcgaggccgtccaggtacgcgggcaggttgtcgaggcacggcgcgaacgcgccctgcacccggttctggtagccgaggtcgctcatccgcaagctcgtcgcgtacggcaggtacagcgtctgcgcatcgaacgcgtcgagcccgtgccggtcgccggcgacgaaacccgcgcacagcgccggcgacgcgccgaacagatacagcagcagccagccgtagcgatggaaattgcggatcagggcgagatagcctgccgagcgcatgtcgcgcgcgtcgcggccggccggctcgcatccgtcgcgcacgtcgcgcagcagcggccacacggcatcggcgagcgaatagttgtagtggatcccggcgatgcactgcatcgccttgccgtagcggaacgccagcccgcgccggtacacgtgcttcaggatgccgatgttcgacgtgccataccacgcgatcggaatgcggcggtcgtcgtcgagcgggcacggcatcgactggctccacagcagctcgtcgccgatcgcgcggcacgcgaagcggtgcagctcgtcgagccgctcgatcacgtcggccgcatcgtgctgcggcggcgtgacgaattcgagcagcggctccgcgtagtcggtcgtgatcgacgggtgcgtgagcgccgcgccgagcgcgtgcgggtgttgcgtcagcgcgagccggccggcggcatcgacgcgcagcgtctcgcgctcgacgccgcataacccgtcgcccagcagcggcaggtgtgcggcgtcgctcagcacgccgagccggcggcggtacggcgtcgtcatccatgtggatcggggtgaatcgtgggtcattgcggtctcccggaacgaaatctggcgacgcgccgctcagtcgagcgggctcttcggccgcggcaggccgatgtgttcgcgcagcgtcgtgccttcgtagcgggtgcgaaacagcccgcgccgctgcagctccggcaccaccatcgtcacgaagtcgtcgtagccgtcaggcaccgtgtagaacacgacgatgaaaccgtcgcacgcctccgtcatcagccactcctccatctggtcggcgatctctgacgcggtgccgaccatctcgccggtgccggattcggccgcccgcttcgccagctcgcgcaccgtcaatccctcgcggcgcgcgagcgccgcccattcgcgctggttgccctgcccctgttccgtgtgcggcagctcgggcaacggcttgtcgggatcgaacttcgagcagtcgacgccgagccggatcgacaggttcgggatgttgctgtccacgtggacgagatcgtccatgtagcgcttcttcgccagcgcctccgcgcgcgtgcggccgacatacacctggttggcgggcaggatcttcacgtgatcggggttgcgccccgccgcgaccgcgcgcgacttcacgtcgcggtagaacgcacggcccgtctcgatgctgcgcgcgttgccgaacaccaggtcggccgaacgcgcggccatgtcgcgcgcttcctccgacgcaccggcaagcgcgatcaccggccagccctgcacgggccgcgcgatgttcagcggccccttgaccgagaagaacttgcccttgtggttgagcggccggatcttgtcgagatcggagaacacccccgcctccttgtccatcacgagcgcgtgatcggaccagccgtcccaaccccgtcacgacgtcgaagaactcctcggcgcgctcgtagcgttcggcatggcgcagcgcggtctcgagaccgaagttgagcgcagcctccgggttcaccgtcgtgacgatgttccagcccgcgcggccgccgctcaggtgatcgagcgacgcgaagcggcgcgcaagcaggtacggatcctcgtagctcgtcgtgccggtcgcgatcaggccgatgcggtcggtgcatgcggcgatcgccgacagcatcacgagcgggtcgtacgacgtgatcgtgccgctgcgcttgagcgcattcggcggcatcggcatcaccgcgaggtggtcggcggtgaagaccgcgtcgaagcacgcgtgctcgagcttctgcgcgagcgaccggatcaccggccagttgaagttcgcgagcgtcggcgcgctcgggtgccgccaccacgccgtgtgcaggcagatggggcgcatgaatccacccaggcagagttgcttcgtcatacggggctcctcgtcattggaatacggcgcgaaacgtgcgggccgcgcgcgtgctgctcgtgtcggcgtcagcgcgcggcgttgaagcgggcgaagccggcctcgaggtcgccgatcaggtcgtcggcgttttcgagcccgatgtgaaagcgcacgcacgggccgcccgggtcccagtgcgacgcggtgcggtacgcactgcagtcgaacggcatcgcgaggctttcatagccgccccatgaatagccgagcccgaaatacgcgagcccctcgagcagcgcggcgacggcctgcgcgggcgccgggcgcagcacgacggagaacagccccgtcgcgccgccgaagtcgcgcacccacagcgcatggccgggatcatcctcgagcgccggatggcacacgcgccgcacctcagggcgcgcggcgagccagcgcgcgacgcgcagcgcgttcgcctggtgctggcgaagccgcacgccgagtgtccggatgccgcgcagcgtgaaacgcgtcgtccgagccgacgcactgccccgtgtcgcgctgatactgttcgagcgccggcagcgcgcgcgcggacgccgacaccatgccgatcatcacgtccgcatgaccggcgaggtacttggtgccggcctggatcacgagatcggcgccgtgcgcgaacgcgtcgaagaacagcggcgtcgcccacgtgttgtcgaacagcaccacgagcccgcggtcgcgcgcgagcgcggcgaacgccggcacgtcgcacagctccatgctctgcgacgcgggcgcttcgagatacagcgcacgcgtgttcggccggatcagcgcggcgagcgcgtcaaccgacgcgagcggatcgaagtaggtcgtctcgatgcccgcgcgccgcagcacgccgtcgcacaactggcgcgcgggcttgtacaccgcatccgtcatcagcagatggtcgccggccgacaggcacgacgacagcgcggtcgtgatcgcggcaagccccgacgggcacagcacgacacccgcgccgtgatcgagcgcgcgcaccgcgtcctgcagcgcggccgtggtcggcgtgccgcgccggccgtacacatatggctgcgtgtagccgagcaggtcggccacgctcggcgcgagcaccgtcgagccgcgatacaccggcgggttgacgaagccgtgatacgcggccggcgcgcggccgcccgtgacgagcacggtgtcgacctgcgcatcggccgccgggtggttcggggcgggccgcacggtcagcccttcacgatccgcacggcgccgcgcgccgcgctcgtcgtcatcgccgcgtatgcgcgcagcgcgcccgacacgcggcgctgccgcttctcgggctgccacgcacgcgcgccgcgctcctccatcgccgcgcggcgcgccgcagttcgtcgtcggacacgaggacgttgatcgagcggttcgggatgtcgatctcgatcgcgtcgccgttctcgagcagcccgatctcgccgccctccgccgcctcgggcgatacgtgcccgatcgacagccccgacgagccgccggagaagcgaccgtcggtgatcagcgcgcactgcttcgcgagccccttcgatttcaggtagctggtcggatagagcatctcctgcatgcctgggccgccccgcggccctcgtagcggacgatcacgatgtcgcccgggccgaccgcaccgccgaggatgccttcgaccgcctcctcctgcccttcgaacacgcgcgcggtgccggtgaacttcagcatcccgccgtcgacgcccgcggtcttcacgatgcagccgtcgcgcgcgatgttgccgaacagcaccgcgagcccgccgtcgcgcgagaacgcgtgctcggcatcgcggatgcagccgttcgcgcggtcgagatcgagttcgtcatagcggttgtcctggctgaacgcgacatgcgtgcgcacgccgccgggcgccgcgcgatagaagcgcgacaccgaatcgacgcgattgcgcatcacgtcccagcgcgcgagcacgtgcgcgacgctcggcgcatggacggtcggcagcgtcgtgttcagcagccccgcgcgatcgagttcgcccatgatcccgatcacgccgccggcccggtgcacgtcctccatgtggacgtcctgcaccgacggcgcgaccttgcacagcaccggcacgcggcgcgacagccggtcgatgtcggccatcgtgaagtgcacctcgccttcgtgcgcggcggcgagcaggtgcaataccgtattggtcgagccgcccatcgcgatgtcgagcgtcatcgcattctcgaacgcatcgcgcgtcgcgatcgagcgcggcagcacgctcgcgtcgtcctgctcgtagtagcggcgcgcgagatcgacgatcgtgcgcccggcctcgatgaacaggcgcttgcgctcggcatgcgtcgcaagcaccgagccgttgccgggcagcgcgagcccgagcgcttcggcgaggcagttcatcgagttcgcggtaaacatcccggaacacgagccgcaggtcgggcacgcgacgttctcgaccgcgcgcacctcgtcgtccgtcacctgggagtcggccgccaccaccattgcgtcgatcaggtcgaacgcgcggcgcttgccgcggaacgtcagcttgccggattccatcgggccgcccgacacgaagatcaccgggatgttcaggcgcatcgcggccatcagcatccccggcgtgatcttgtcgcagttcgagatgcagaccatcgcgtccgcgcagtgcgcgttgaccatgtactcgacgctgtcggcgatcagctcgcgcgacggcaggctgtacagcatgccgtcgtggcccatcgcgatgccgtcgtcgatcgcgatcgtgttgaactccttcgcgaccgcgccggccgcttcgatctcgcgcgcgacgagctggccgagatccttcaggtgcacgtgaccgggcacgaactgcgtgaacgaattgacgaccgcgatgatcggcttgtcgaaatcggcgtcggtcattcctgtggcgcgccacaggctgcgcgcgcccgccatgttgcggccgtgcgtggaagtgcgtgaacgataggtgggcatcgtgatcctcggttgattcgttgcgaaatggggcgggcagcgggctgccgtcaatgcggcctgccggccgcgccccagttgttgtcgttcttcgcgagcgtcggcagcacgaacgacaggatctttctccggtcgagatcggacgacacgctgagcttgtattcgagcgccgtcagcttgatcacgatggacctgagcgcctgggtcaggcgttcgtagccccttcgaaatagagtgagccgccacgctgcgcgatcacgccgtgacgggacaggtaatgaaacagcgcgaccgacgagcgcgcgtcgtagttgtcgagcggcggcgcctgcagcgggtagcggatcaggcgctcggccaggatgtactggatcgaagcgcgcagcacgcggtcgtccgagcgcagccggaacagcgcgaggatcgacaggatgtcgacccgcaactcctccgcgcccgcaccgttgcgcgtgctcttcgcatcgaggtactccgggatcggcaggaagcccgtgcgatggtggtactcgtgcaggtggacccagatcgcgctcgcctgcgtcagcagctcgtcgtccgccgcgagcagatccgggaacgcggtgggcgaccagttcgcctcgattgccgggcgcgtatggcgcttgaagcgctcgacgaacttgtcgatgaagtaatacgccttgtgatacgcgcgcaggtcggcgtcgatgaagttctcgccgaataccgcgaccgcgagcggattgagaaagccgtccgtgcacatgcggatctgcaccggcagcgcgttgccgtccggcgcgatcgcgagcacgctcggcggaatcggcacgggcgcgatagcggccgcctcgaggaacgcgtcggcgttgtagggcacgtcgaagaacccgaggatgaagctcgggtccaccgagtacgtgagatcgagcaggcgccccgatgcgaggcagcggttctccagcgccacgagcagcgcacgcacatgcgggttgtcggcgtagtcgccgagatgcgcgcgtgcgcactgcgcgatgcgcgcgacgtcggtgcgaaaaccgccggcgaggatctcgccgcggcagcggttggtggctagtacgatttcgcgtttcatgtcggtcatcctgtcggcacgcgtcgtcacacgacgcggaactccctgcagatagacgagcgtgtcgtcgtcgggcgccgcacagtgcagcgccaccacttcgccgaccagcagctcgtgcgtcgccgcgctcatcgacgcgacgagccggcagtcgagcgcgatgcgcgcgctcgccagcaccggcgcgcgtgtcgcgagctcgccccactcgcccaccgtgaagcgcgcgtcgcgctcgtgcgcggtcctgcccgcgaacacgtcggcgagaaaccggtcggcggcgccgagcgtgttcacgcagaacacctcgttcgcgatcagccgctgcgccgatacgctgccgcgattgacggacacgagcaccgtcggcggtgcatcggacaccgacagcacggcggtcgccgtcatgccgcagcgcccggcaggcccgtcgctcgtgagtacgtgaacggccgacgccacgcggcacatcgcgtcgcgaaagcgctgcggcgaggcgcccatcgactggtcggggaacagtgcgggttcgttgtggatcatgtcctgtctccgtgcatggggaaaagccgcgcatcgctaccggttcaccagcgctttcggcagcgacagcgcgagcagtccgcccagcgccatgcagccggccatcatgtagaggcccgcgtcgttcgatgcggtcagttgcttgagcagccccatcaggtaagggccgaggaagcctgcgagattgccgacggaattgatcatcgcgatcccggcggcggccgcggtgccgccgaggaacgcggtcggcaggctccagaacagcgggatcgcggtgaggatgcccatcgtcgcgagcgtcagcgccgcgatcgcaagccccgtctgatgcgcccagccgaccgcgagcacgagccccaccgtgcccatcgcaccgggcaccgcgaggtgccagcggcgctcgcgaaggcgatccgagctgcgtgcgatcgcgatcatcgcgaccaccgcaagcgcatacggcaccgtcgacagcagcccgatcgtcagcggatcggccacgcccgtcgcatggatgagcgtcggcagccagaagccgacgccatacaggccgatcacgaacgagaagtagatcgcgcacatcagccacacgcgcggattcgcgagcaccgcaccgagcgacaggtgagacttgaccgcgtcctcggcattcacgttgcgttcgagcagcgcgcgctcttcgtcgttcaaccacttcgcctgcgcgatccggtcgtcgagcagcgcatagacgagcaatcccgcgacgatcgacggcagcccttcaagcagatacagccactgccagccgtgccacccgttgatgccgtcgaacgccttcaggatgtagccggaaatcgggccgccgacgacgcccgacagcgcgacggccgtcatgaacaccgtcgtgatccgcccccgccgatgggccggataccagtaggtcaggtacaggatcacgcccggaaagaagccggcctcggcggcgccgagcaggaatcgcatcgcgtagaacgccgtcggcgtcgtgacgaacatcgtcagcgcggacaccgcgccccacgtcaccatgattcgcgcgatccagacgcgtgcgccgatgcggtggaggatcaggttgctcggcacctcgaagatgaaatagccgaagaagaagatgccggcgccgagcccgtaggccgcgtcggacagcccgagatcgcctgccatctgcagcttcgcgaagcccacgttcacgcggtcgagatacgacaccaggtaacagaacagcagcaacggcatcagccgccacgcgaccttgcgataggcggcgtcttccgacacccgcgctgcgggcaatacggtcgatacgagcgtctccatgatttttccttgtttgcgatcgattgtcattcgttgcgcacggcgtcctgcacgcgtcgcccgacggaggcacccgcgatccggcgcacaaggcggcgagccgtcctcctccggtcggctcgttctcgcatgcgggtgccgcgtgccgcacgcatgtgtgcggcacgccgggcgggtgtcgatccggctcgcgggcgcggatcaggtgcgcatcggcctcgcgaggtccgttcgtggcgttgccgcggttccggggctcgttgtacgtcgttgtgcccgggcgctgcgtcgcaggcaacgcgcaagatgcgcaaaacgcgcggatggtcgaaagccttgttcatgttcaaccttttgctcacatgcccgcttagggcgcctttaaaacgctcgtcgacgttcgaagtcgcgaacgcaccgctggatcgggcgctcttgtggagcgctcgatgccttgattccgtcatgccgcacgcggcggccgatcgcgcagccccgccatgtaggcgaccgtgcggtcgcgatacgccgccgacacgcccgcgtcggccagcccgcgaaccagcaggtcgcggtagcgcgctcggcgcggcgtcgcaatcgagcgtgaccgcaccgcgatacgtcagcgcatgtacgcgctgcccgcccggcgccagcacctcgaccgcatagcggacgtagcggccgagatgcacgccttcgcgacgctcgagcgcgtcgagcatgcgcatcggcaaccggtacagcgcgccctcgacgatcgcaccggcagccggctcgatgttcgcgcagcagaccggctcgttgagcgacgcgtaattgaacgcgaggcgatggccgtcgaggcgcgccgcgcccgcgaagtacgtcgccgcgtcgcagccgagcgacgtcgacaggctcgcaaggttcatgcacgagccgtatgcgaaatacgcgaacggctcgttacgaagcaggtcgtccggcgtcatcgcgacgcgctcgcggcatgcggcgtgccgagcacgtagtggtcgtagatcgccgcgaccgacgcgatcgagtcgagcacgaagtcgccgatcgggatgtcgatcctgagcgtctgctcgatgaacagcacgaagtgcacaagcgacagcgaatcgagcaggttggcgtcgagcaggttcgtctgcgcggtcacgcgcgccggcgcgcccgggtcgatcccggccagaaacgtcttcacgctgtcgatcaattcgtcgaggctcatcatccgcatcacgatcacgctccagaaacgcacgttcatcccggcccgcgcgcatcgcactggccggcttcgtcttcaccgaaccacaagatccttcacatcgcccttcgcttttgactttcgatcgggcgtcatgcaccatgcgacgcgtcgacacgacaaacccggtcagcatctccaccagatataaataggagacttaatcaatatgacaactcatacgctgttctactgccccggccatctttcgtttgcaccgcacgtcatcctgcgcgagctgggcgaaccattcgaactcgcactcgtctcgatcaaggacggtgcgacgcagagcgccgaattccggcagctcaacccgaaaggcaaggtgcccgtgctgcacaccggcgacgaagtgctgacggagtcgtcggcgatcctgctctatctcgcgctgcgctttccgcaggcgcggctcgtgcccgataccgcgatgggcctcgcacgtgccgtcgagtggatgaactggctggcgtcagtgttgcccggaacggtcgcgctcaacttccatccgtcgcgtttcagcgaagacccggctgcgcacgacggcattcgcgcgaaaggccgcgcgggcatcctcgctgcgtatgcgcagattgacgaacggctcgcggcgcgcgactgggcgctcggcgagcactactcgatcgtcgatccgatgctgctgatatttttcaaatggggaacatgctgaagctcgacatgcgcgggttcgaacattgggccgcgcatacggagcgcatgctccgccgccctgccgtcgcgaccgcgttgtcggtcgaacagatctcgatctgggcgtagcggcgaagccgggtcgggtttgcgcccgatccggaatgccgcccgcgtccgtcgcgtctccttcatcttctcaggtccttttcgccgcttttctttgtctgttgcgccgatcctgcacacgcgcgcacacatgcgtcgcgcacgccgcggatcgtccaggccacgactccgggaacaggagccacgaccgcaatcgcatatgacgttctctgctttcgcggcgctacaccgctcagctcattttctgcgatcgcatcgaatgcgtgaacaatgcaacatccatttcgtgacgtccaatatatttttcgtcttccactaagtcgccacgcatattagtcatcgattggccggcgagtccgatattgccaatcctggcgaattgattgcgacgaatggagcgggattggcgtgcattgccggggcgaaatcggcttcaactggcgaccaaccccgagcggtttcgatggtgcacgccagcaacgcaatccaacttccggatttcgttgattgcggtcactgaatgcttctgctgccggcgtcgtgccggcttgttccgccgaggtcgttggaagcgcaacgaaagccacggtggccgtgcggaacggcggcccgccgctcacgaacgacaaagtcgagcccggctgcgtatagccgaacgcatggcgccagccagcccgtgggccattcggatcgccgatgccaattcagcggcgcaggtgcgccgcgccgccgaacaaaaggaaattgaccggctcgccatcggcagcaaacgcgtcgccgcctggggccgtgagcatgacaatgagaagcaggcgcgctcaatgcaaaagcgtgtcgacaaactcaagaaagaccggaccgtcgccgcgatgagcggcggtaagcgcgcacgtctgctgtttccggcacggtcgacggccagcgatcacccgcgatgatcggcctcccgcacgctacgcaatccgcaggaacatccccgccttctccggcagcgacgacggctgaaaaccataacgttcatagaacttcggtgtgccgtgatcggccatcaagctgacatacgcggtcggcggcgcattctcgtgaacatagcccatcagcgcccgcatgatcaggtcacctacgcctttcttctggtgagcgggcaacaccgcgatgtccacgatctcgaagaagcagccgccgtcgccgatgaccctgccgattccgaccggcacaccgtcgcagtacgccacgacgctgaagagcccgttcttcaacccgatcgtcgcggcctgttccgacttcctgctcaaccctgcggcaagacgaatgtcgatgtaggtggataccggcggaacttcgtgtcgaacgatgtatgccatgcgagcctttcaggtaagccgtacaggcgaatgaatcggccccgccgcggatgagtccgtcgaacccggagcccgaacgcacgcatcaaacgagaccatgacgacgaatcgggcgaggcggcaggccgcgggtacaacgacccaccgcccacggcctcgcccaggtccgccaagcggcttagagaatccgctccagcgcgtcggcaaaccgcgcaaccgcaccgtcgacatcatgcagtttgtccaaaccgaacaaccccaggcggaaggtcttgaaatcctccggctcgtcgcattggagcggcacgccggccgcgatctgcaagcccacgtcggcgaacttcttccccgatcgaatcccgtcgtcgtccgtgtagctgaccacgacgcccggcgcctcgaagccctcagccgccacgctccggaaacccttgtcggccagcagcgcgcgaatgcgcttgccgagttcgagctgctccgccttcaccttgtcgaacccgtatgcctcggtttccttcatcacgtcgcgcagcgtcgtgaggctgtccgtgggcatcgtcgcgtggtacgcgaacccgccgccctcgtaggcttccatgatctgcagccacttgcggagatcgcacgcgaagctggtgctggtcgtgccgtcgatgcgctcgcgtgcgagcgggctcagcatgaccatcgcgcagcacggcgacgcgctccagcccttctgcggcgcgctgatcaggatgtcgacgccgctcgcctgcatgtcgacccacaccgtgccggacgcgatgcaatccagcacgaacatgccgccgaccgcatgcacggcgtcggccaccgcgcgcagatacgcatcgggcagcatcatcccggacgcggtttcgacatgcggcgcaaagaccagatccggcttgtgttccctgatcgcggcgaccacttcgtcgagcggggccggcgcatacgcggcctgccgccccgcttcgaccgggcgcgccttcagcaccgtcgtttcggacggaatgctgcccatgtcgaaaatctgcgaccagcggaaactgaaccagccgttgcggatgaccaggcacttcttgttcgttgcaaactgccgcgcgacggcttccatgccgaacgtcccgctgcccgggacgatcacgaccgacttcgcgttgtagactttttcagtgtgccggagatgtcgcgcatgacgccctgaaagcgctgcgacatatggttgaccgagcgatcggtgtacaccaccgaatattcgaggagcctcgcggtcaacatcgggaagtaaacctggcatgctcgcctccggtgaaaaatgaacgatgaattccgggcaggcagtgtccgtgacgcgataccgccctgccccaatgcaattgcgctgtttcctcgacgaaagcagattctaacgaacgccgcccgccgcttggggcatattttggcggctgcccggcgcaggtccggcatgacgcaccgcaacgcggctgccgtggcgcccggtcgaatccccgccccgtagccgcccgcgtcggccggtgcggcgcacgaagccctgttcgacgtatggataaacgccacttcccgggcatgccgcctaccatgtcggctcacctttcacgacagagtcttcgatgatccccaaccgcgcatcatcccggcagccgtcgaccgataccgcactcgccgagcgcgtcgatgcggtactgtcccgtcaactcgaaacacatcgcctcgttggtgcggtcgtcctgatcgcacgcgacggcgaactcgtctatcgccgcgcggccgggttcgccgatcgcgaagcgcgcacgccgatgcgcgaggacacgctgttcaggctcgcatcggtgacgaagccgatcgtctcgacggccgcgatggcgctcgtcgcgcaacacaagctgtcgctcgacgacgacgtcacgcgctggctgcccgggttccgcccggcgctgcacgacggcagcgtgccggtgatcagggtgcgccacctgctcacgcatacggccggcctcggctatcgcttcacggaagccgacgcgaccggcccctatgcgcgcgcgggcgcctccgacgggctcgacgccgcatcgatcacgctcgccgagaacctgcgcaggatcgcgagcgtgccgctgcagttcgcgccgggaaccggctggaactattcgctttcgatcgacgtggtcggcgcgctgatcgaggccgtcagcgggctgccgctcgccgacgccatcgatacgctcgtgctccgcccgctcggcgcccgcgacacgggattcgtcgcacgcgatcccgcgcggctcgcgacgccctacgtcaacgacacgccgcaaccgcaccggctcgccgaaaacgaaaccgtgcccatcttcgacggaaccgtcggcgtgacgtattcgccgtcgcgcgcgctcgacgcggatgccttcccgtcgggcggcgccgggatggtcggcaccgccggcgacgtgctgaacgtgctggacacgctgcgtgcgggcggcggctcgctgctgccggccgacctggtcgacgagatgggccgcgcccacaccggcaacctcgaattgcccgacctgcccggcgcggggttcggcatcgggttctccgtattgcgcgacccgctcgcggcggcatcgccggagtccgtgggcacgtggcgctggggcggggtctacgggcattcgtggttcgtcgaccgcgcccgcgggctcaccgtcgtgtcgctgtcgaacacgctttacgaagggatgaacggccagtacacgatcgatctgcgcgacgcgatctacgacgccggctgacgcgcgcaacaaaaaggcccgacacagtcgggccaatgagtcgagacacaaggagaatcccgcccaccacaccgggcggggtacgccgcgctacacgacgttcttttcgacgatcgggcggttttccagcacccgcgcccaaccgagcgacgacaggtcgagcgtgtcgtaacgcccgcccagaatgagttcgctgaccccgcgccccgtcgccggcccttgctgcagcccgtggccgctgtagccgttcgcgaacacgacgttgtcgaggtccgggtgatacccgatgatcgcgttgtggtcgaacacgttgtactcgtagtacccggaccagcagttctccacgcgcagcgcctcgaactccggcacgcggttcgcgagcgtcggccagatcacctcgtcgaacaggtcgtggtcgacttcgtcgagcggcaggtcgtccggatcgcgatccgggctcggcgacgtcccgcagatgtacgtgcgcccttccggccggaaatacacgccggtcgggtcgatcagcagcgggcaatccgtgagcctggcaggcgacgacacgttgaagatgctgcggcgccgcgcatggacggggatgtcgatgcccatcatcgacgacagcgtgcgggcccacgcaccggccgcgttgacgagcgtgtcgcacgcgtaacgttcgccgtcggccgtgaccacatgcgtcaccttgcggccgtcgcgcaccaccgcggtcacgtcggacggcacgtagcgcgcgcccagcgcctgcgccttcttgcgcaatgcctgcacgagcccgtagccgtcgaaccagccttcgccgctcacgccatatgagcccgatacgagatcgtcgacgttcagccacggaaacttcgcgcgcagcgcatcgcggtccatcagccggatatccgcgccgaggctcgtctgcagcgcatggttctcgcgcagcgtcgcgtcgccggccggcgtcgcgaggaacaggtagccgccttcgtgcaggtcgatcgacggctggtggccgtccacttcgagccgttcgccgatcgtgcgcaggaagtcgatgccgaacagcgacatctggatcgacagcggcgtcgagaactgctggcgaatcgacgcggccgacaacgccgacgacgatctcgcataggtggggtcgcgctcgatgacggtcacggataccgtgggatcggtggcgcgcaggaaataggcgatcgagctgccgatcacaccaccgccgacgatgacgacttgagaactcacgactgactccagttgcacatgaagggcgcggccacccggccgcgcccgtgggttgttcgtgccgcgtcgcacgcggcgtcgcgcgggcggactcgtgcggctgccgcaccggcgtgcgccgcgatcgcaaccgatcgccgatggcatttcagcacgtccggcagcgccgcgaaagtccgcgcgcgcctgttgcgttcaatccgccgatttcgtcgtgacgggctgccacgcggcgttcttcacctcgtacagcgtcgagctcgggctcttcaggtcgcccgtgttcgtgaacgcgatcgtgcccgtgatgccgtcgtagcgcgtgcccttcagcgcgccgttgaaatcggccggcttcgtcgagttcgccttctgcatcgcgttgatcgcgatccacgtcgcgtcgtaggcgaacggcgcatacgcgagcatgtcgacaccgtacttctgccggaatttcgtttcgaacgccttgcccttcgcgagacgcgacagcggctgcccgtattcccacacggccgcgccttccgccgcattgccggccagcttgatgaagttcgcgttcatcacgccgccgcccgcgaggaactgcgcgcggatgccgagctggcgcatgcgtttcacgagcatcgcggcctgcgcgtcgaggccgccgaagaacacgagatcggcgttggtgctcttgatcttcgtgagctgcgcgctgaaatccaccgccttgtcgttcgtgaattcgcgcgcgacgatcgtgccgccgttcgccttcacggccttctcgaattcgtcggcttcgccctggccgaacgcggtgcggtcgtcgatgatcgcgatgcgcttcgccttggtcacgctcgccgcataggcgcccgcgttcccggcgttctgcgtatcggtcgcgatcacgcgatacacggtgccgagcccggcgcgcgtgatgtcgggattggtcgccgacggcgtgatcatcggaatgccggccttcgcgtagatcttcgacgcaggcagcgtcgtgcccgaattgaagtggccgatcacgacggccacctgcgcgtcggcgagctgctgcgcggcctgcacgccggtgcgcggatcgctctggtcgtcctgcgacgcgacgacgaacttcacgggcttgccgcccaccgtcggatgcgcggcattcgcttcgtcgacggccatgcgcacgccgttctcgatgtccttgccgtaggcggcgccgccccgtcagcgggccggcgacgccgaccttgacgaccgtctcctgcgcgtgggccgcgcccgtctggagcgcgagaatcgcggcggtcaatgcgacgccggaaagcgaacgaatgcggaacgtcatgacaatccttgttctgggggccgggatgcaacgcgcgaccaccgcgcgtcgacaccctctcgcgtgccggtcgtctcgtccgctaccggggcgtcgtgcgacgcacccggccggtcgatcgccgcggctccgtctccgaagagcctttcatcgcgaaagaggtgaatggattgtgggtagccaatacccgtgcagcaaacgaaatatcggaactatgtagtgaggatttgtcatcaagttccgcatgcgcggccggcccgcggcccgcgcaaccgtgaaccgcgggccggcagttttcatgggaagcggcgccggcgcccgtccatcaaggccggtcgtggtcatgccggcagcgcatcatcgttgcgatgacggcccggccggccaccgcgacgcccgtggcgccgcgttatcggtcagtgccgatcggcgcccgtctgcttgcgcgccgcatccgccgcctcgccggcctgctcctgaagcttgccggcctgctgttcggcgacgccttccgcttccgtcttgcggtcgcccgtgaccttgccgagcgcttccttgaccgaacccttgacctgcttgagcttgccttcgatccgattcctgtccatggtcgtctcctgcgatggttggggagaaccggcggcatgacggccagcgccgcgccgccgaatggacaggatcgcaagcgggcgccgtgcgcggcagatgcggatgcaccagcgcgcatggtgcattcgtaccgacggcgtcagtccttgccgttctcgcccgccttcgcgccgcgcgtgccgttcgcgtcggccgcgccgacgattccgcgttcgcgcgcccatacgatcgcctcgccgcggctgtgcacgtcgagcttcgcgtagatcgtcgcgacgtgattgcgcacggtgttcggcgcgagcccgaggcggccggcgatttccttgtcggcgagaccgtggcacagcaggtcgaacacgtcgcgctcgcgcgcggtcaggtccgacagttgcgcgcccgcatccggcgcgttcgcacgccgcacgttcgccagcttctcgatcagcgtgcggctgaaccacgacgcatcctgcatcgccgtttcgatcgcgtacacgagttccatctccgtgcgcttgcgatcgctgatgtcgagcagcgcgacgagcaggcagtcgcgcccgtgtatcgcgacggggtcggccgacacgacgcaatcgcgcacgtcaccgtcgcgcgtgcgaatctgcacgtcggcgttgcgcacgctgccgtcgcgcgcgagccggccttcgatgcgctgccatgcgccgcgttcggcccacaacccgatttcctccgcggatttgccgagcaggtcgtcctgcgcatggcccgtcatcgcggcgaacgcgccgttcacgtcgagcaattcgaagcggtcggccgtgacgatcgcggtggcgaccggcgccatccggaatgccgtcgcgaagcgttcctcgctctgccgcagcgcgcgctcggcctgcttgcgcggctcgagatccatgaacgtaaacagcatgcatgcctcgtcgttcatgtcgatcggctgcccggcgacgaccacggccttcgtgctgccgtccgcgagtttcagcacggcctccatctgcggaatcgtcgcgccttcgccgagccgctcgatcgcgagctcgcgccgttcggcctgttcgagcacgtcgagctcgtacaccgaacggccgagcacgtcgtcgcgcgcgtggccggtcatgtccagaaaaccctggttgaccttcacgtagcgcaggtcgtcgagccggcagatgacggccggcgccgggttcgcgttgaaggtgcgctcgaagcgctcctcggcgctcgcccattcggtcgcgtcgtgcaacaccagcgcgaggcagtcgggttcgccggccgcgttcgtcagcacgaggctgcggatgcggtggacccagctcacggtttcgtcggcggccgattccacttcgaccgtcacgtcgctgaactcctcgcccgcgatcacgcgatccatcggatagtggccgtcgcgcaccggatggttgttccggtagcgcagccggaagcgctcgcggtaatcggtgacggtctcgccgagcgccttcagctcggtcacgccgtgcatcgcgagcgcggcctcgttcgcccagacgatccgctggtcgggctcgaccaggatcacgccctcggtgagccccgcgatgatctggtgcagctggcgccggtcggtatgcgacttcagcacctgttcgtttacctgttcgttcatcgaatgcttgtccatgtcgtcagcatgaccgccggcccggttgccgcttcgtcgacacgcgccggccggcgcgtgtggcgatgatcgcgcgccgcatccgtgcgcgacaggcgcggatgcactaatcgccatagtacattcgcaccgcgtgccgccaccgtgcggcatcccgccgatcccggaagcattctccgcgcctgctttgcgcgcgccgcaccccgcgagcgccccctcccttcacgacaccccgtgcaaacgcactagccgatcaggtgaatttgcgcgatgcccgtgcacgttcgacccggtacgctggttctgcatcggcgctcatgcgctgccatccgaaccgcagaggagaagcacgatgaagctgcatcagacacccgatccgacgcggcccgaaccgcctccggacaacccgcccgaaccgccgcccggcaccgatccgccggttccgctgccgcccgacgtgccgcgcccggacatgccgccgcgcgagcccggctacgacacgccgatcgccgggtaatggagtaacgcgggagtaacgcgcggcacgatccgtgctcgacgatcggtccactcaccccatcaatcgaaggagaacatcaatgaacaaaatctcgcacctttcgacactgctcgccgtcagcgcggctttcctgctcggcgccgcgccgctcacgaacgcggttgcgcaggacgcatccaccgacaacggcatgaagaccgaatcgaaccagcccgtcaccgacacatggatcacgaccaaggtgaagggcgagctggccgccaccgacggcctgaagagcgtcgacatcagcgtgaagaccgtcgacggcgtcgtcacgctgaccggcgtgctgccgacgaagatcgccgtgaagaaggcgatcgccgtgtcgcgcgcggtcaagggcgtgaagcacgtcgacgcatccggcctgaaggcgaaggcctgacctcccggcgcggcacgccgccgcgcttttatccctgcacgacaaggagcacacgatgaacgaggacaagatcaagggccagtggaagcagctcaccggcaagctgaaggccaagtggggcaagctgaccgacgacgatctggccgtcgccgacggcaatcgcgagtatctcgccgggaagatccaggaacggtacgggatcgcccgcgacgcggccgagaagcagttgaaggaattcgaccgcgagctgtgacgcgacagcacattcatgcaaccgccgcggcgccgacggcgtcgcggccaccaggacctacgacatgggcaaatacctgatcgcctggctgctcggcgtgccggtcgggctgctggtgctgttctttctgatcacgcacgtattctgacggcacggggcgcggcatgggccggccgctttgccgctttccactttccactttccactttccccaaccacatcgatgaccttgacgccgcgatccggcattcgcccgatcgcgcgtatcgcgttgcatcgcgagccgccgcccaacgcaaatcgggcaggacgcccttgcgccctgcccgatttgctcatttcttccgaaagcggcgtaccccgctttcgcttccttacttcgccgcgttcgccgtcatcttgaagatgccctgcgcgttgcccgcatcgaaacgcaggtcggtcacccagcggcgcgccgcctggtcgaacgtgcgcttgcgcgtgatgaactcgtagaacgagcccggcacgttgcgcttcaccgtgccgccgtcgcgcgtgcggaactcgcgctcgacggtgtcggcacgatacgcggtctgaaacacgcggcccgagcgcgagcgctcgacttccggcttcatcggccggcccttcgccttctcgtcgtcggacagcttgaacacgtcggccacgcgatcggtcgcatggttgaacgcattgccttcggtcgcgatccacgccatttccgccgattccagcagcagcgtttcgtaatcgagctcgttcggcacatcgtgctggcgcgcgaacgcaccgacgatctccggcagcagtgcgtgcgcggcgtcgagcgacagccagccttcgcgctcgacttcccacagcagcgcgacggccgccggcgacagcggatcgcgcgacgagctgacgatgttcgtcacggcctgctggaattccttcgagaaacgttccggatgcagttcgctgacgaagaactgcgcgatttcgtccggcgcgtcttcatgcgcatacgcgcggcccgtcatgccgagcttgtcgagcgggtaacgaccgttcaggcggaagccgagcggacgcaggatgcgcgtgaacgcggcctcgcccggcggcagcgcgcccgtgtgcggccagcgcaccgtgcgcagcgcaccgtggtcgaaatagaccgagccgccgctttcgatcgcgtcggccgtgtacgcgcggccgttcgccgaacgctcgagcagcccttcgaacagcgccatgttcatcgcctgcgcgatttccgcgcgcgtcacgacgccgtcctcccattcttcgaggatggccggcatgttcagggtcgagaacagggcgtcggtcttcgcctgtcccagcagcttcgtcagcaagctctcgatattcggattgcgcatcaggattctcgtctcggggaccgccggcaaacgtgccggcaactcgtcggccggctgcccagcgggcgcctgaccttgcgtggggagcattattcaaagggttgcagccgggcgtaaagcgagattaaattgatacgtgatgagttttggaattatcagccgttcctcggccccgccttccgcccgacgccgcgcgggcctgaccgtcagacgaatcgaacatcatgcgcaaattcaagatccccaacatgggcgcgctcgtggctttcgaagccgccgcccgccacgagagcttcacgcacgcggccaaggagctgttcctgacggaaagcgcggtatcgcgccagatcgcgacgctggaagccagcctcggcgtgcggctgttcgcacgcgtgaagcagcgcgtcgtgctgacgcgcgccggcaagctctacggcacgcaggtgcgccgcgcgctggaggcgctcgaccgcgacacgctgtcgatcatcgcgcacggcagcggcggcggctacctggagctggcggtcctgccgaccttcgcgtcgcactggctgatcccgcgcatcaagagcttctacgaccgcacgcccgacgtgcgcgtgaacatgggcagccgcaccgacctgttctcgttcgaggacacgcacttcgaggccgcgatccactacggcaagccgacctggcccagtacgtcgtccgactacctgttcggcgaggaagtcgtgccgatctgctcgcccgcgctgctcgaccggcccgtcgagcgcgtcgaggatctgctcgcctacccgctgctgcactcgacgacacgccccggcgcgtgggcgcagtggttcgagacgcacggcgtcgaggacatccgcacgatgcagggcgtgcgctacgagctgcacacgatgctgatcagcgcagcggcggccgggctcggcgtcgcgctcgtgccgaaattcttcgtcgaggaacagttgcagcagctcggcctggtcgtgccgtgcgacgcagcgacggtcggcgattcggcgtactacctcgtgtatccgacggagttcagccacagcaagccgctggagctgtttcgcggctggctgctcgagcaggcgagcgcgtatgcggcgccggagcgcgtggaggaggatgccgatctggaggatgacgaggatgacgaggacgtcgagtaacgccgcggtggcgtcagcgtgcggtggcgttgcaggcgtgccgcaccggcacgctggccttgacgactttcaccagccgcgcgctatcgggcgtttccagccccgggcacgcggtatacagatcgcggatcacgagcgtcgcgcgcccgtcgagcaggcaaacgccgtgcggctgcgcggcgggcagccgcagcccgcgtcgcgcaacgtcctggttcgtgaaaacgatcatgcccgcacgttgcgagcggtcgggcaagcgcatcgccgacgcatcgtcgtcctcgaaccacacgtccggcccgaccgcttcgtcgtcgtaatcgaccgcgtaacgccccgacagcgtgatcgtccggtcgacatgcacggcatggcattccggctcggcatcggccaggatcggctgctcgcccgccgcggccgggccgcacgccagcaacaatacggcgcacaacgtaccggcgcggccggtcaggttcgatacatcaagcgcttggcggatcatggggagcgaaaggcgggccatcgtgacgacgacccgcattgtcgcgcaacgcccgcgtgatgcgcgtgacgagcgtcacatatgccacttcaccgtcgcggtgagcgtgcgcgggtcgccgggcatgttgtacaggtcggcattgccgtgcgcggcaatgaagtagcgacgatcgaacaggttgtcgagcgtgagcgtcacgtcgaccttcttgctgcgatagccggcgccgagattgaacgtggtgaacgacggcagcgtgacgagatcgctcgccgacgtataacgcgccgactggaactgcatgccggccgccgcatagaagccgtacggcagctcgcgcttgatccacaggttcgcgctgtggcgcggcatcagcccgggcgtgttgctcgccaccgtgacgcccgctgccgtcgattgcgccgagccgtcgaccgtcccgttcaggtacgcataacccgcatacaccgaccacttcggcgcgatctcgccggtgaagcccagctccatcccgtgcacgtgctgcgtgccgatcggcagcgcgtagccgggattgttcgggtcgccgatctgctggttggtctggcgcatgtcgaacagcgcgacgctcgccgtcgccttgccgccgaggtcgaagcgcgagccgacttcatacgcggtggtcttctgcggcgcgagcgcggcgccgttcgcgaacgcgccggcactgatcagcgtatcggcgagcggcgagaacgactggctgaacgacccgtacagcgtcagccagtcgagcggttcgtagatcaggccgacgcgcgggctccacgcgtgatcggtacggtcgaggttgacgttcgacgacgtgtagtcgtggcggatctggttcaggtagtcgaaacgcagccccgcgagcaccttccagtgctcggtcagcgagatcaggtcctgcgcatagacgcccgcgagcccgatgacggtcgacgcgttcgtcttcgcccgcgcgcccgtcggcacgccgggcaggatcacctgctgcggattgaacagatcgtaggtcgcgaccttcgacacgctgtagatcgtgtcgaacttctgctgctgcgacagctcgagcccgtacagcagctcgtggcgcatgccgaacagcgaggtcttctgcgtgagttcgaacaggccgtcgatgccgtggtcggtgcgctggcgcgtcgactggtcgagcgtcacgaccgggtgcgcggcaatcttgatcggctcgtacgtcacgtagttcttgcgttcgagcgaaaagtcgtacgcgcggatcgcgccgtgaaacgacagcgaatcgctgaagcggtgatcgagcgacaccgtcgcgctcttcgcggagatgtcgttgtacgagctgttcactgcgtcggccgagccgtaatacgtgttgatcggcacgtcgaccggccggccgcgatacgcgggcaggccctggtcggacgtgcggcggtcgtgcaggtagtcgaattcgacgttcagcaccgtgtcgcggtcgagcttgaactgcgcggacggcgcgatcgcctggcggttgagctggaactggtcgcggaaactgttcgagttctcggccgcgccggtcatgcgaaaacgcgccgcatcgttcgcgttccagcctaggtcgaattcgccgcgccgctcgccgcgcgtgccgagcgtcacaccgacgtcgcgcaccgggttcgcttccggccgcttcagcacgcgattcacgatgccgcccgccgagccgcgcccatacagcacggccgccggccccttcagcacctcgacgcgatcgacgttcgacaggtcgcggtagtacagcgcgtcgtcacggataccgtcgacgtactggtccgtgatgctgttgaagccgcggatcgtgatctggtcgcgctggccgtcgccgaccgaaaaaccgatgcccggcacgttgcgcagcgcatcctgcatcgacgtcgcgttctggtcctcgatcactgcgtgcggaacgacgttcaccgtctgcggcacgtccatcagcgacatgtcggtcttggtcgccgcgcgcgagtggccgccgtcgtacgacgcatgctcggcagccgcattgacggagatcgcgggcagggtcgccgcggtgtcgctcgcctgcgcgaacgaggtgcgtgcgccggccagcgacgtggcgatcagaagcgcatggcaggcgctcttgttgagtttcatcgtgaacgtaggggctgaaggaaaaacggcgaacgaaaacgcatccggccaacgcgcgcatcacgcggcgaatcgaccgacgaagcgttccgtgaaggagacgatgcgcggggatctcccgtcgcatccgccggccgacgcacagccggcgcgggtggctgccggccggcggaaccggctcgaaacgagccgcgacgttctgtcgcgacttgtaacggagcgaaatattaaacgagaatgattcgtgtttttagtaatttttcgacgtgtcgcctgcccgcaacgtgcatgcactcagcgctccgtattcctgacgaatacctttccgtttcgagcttttatgcggccagaacgtaattgaaacgaaagaattccatctccccatcgggcgatgaagggccgggtgccaggcgggattcgggatttgacgacgaagagactggagaggatcacgaagcatccgtcgaagcagacggcctgcattcgaagtccggtgcgcgccggaccgggcaaccccgacccggcgctccgggcagccgacctcgcatcggcagtgcggcggattttcttctgttcttcactccgtgtgctctcaggttcacttcattttttcttcgccgcgccgagccattatccgcgcaatccggccacagggaaacgtttgcgggcgcctgtggcgtgttataccaagcattcggcaacagtctttccggatgctttcaaggcatgcggcacgattcggcaaatcttgcattcatgccggcgttccttttaatggaactggttccattcgctgattcggccatgtttccccgtgacgcttcgtcgtgcgcgcgtcatcatgccgattcaggatcgaggatcgctcagctcaggattcgcatcgcccgtccttcccggacaccccgtcaaacgagaccgtcatgcccgattccgcttccctgcaacagctgtttcccgcctttcaggacattcctgccgagtaccggctcgcttcgccgatccaccagcgcgtgtcgctcgtcgacggcgaattgcgcccgtgggacggcgcgaccaagaccgtgctgtcgcccgtgtgcgtgcgacaggcggacggcagcgtcgagcaggtcgagatcggcagctatcccgtgatgggcgagccggaaagcgacgcggcgctcgacgccgctgtgcgcgcatacgactctggccgcggcgagtggccgacgatgaaggtcgagcagcgcatcgcgtgcatgcaggacttcatcaagcggatggtcgcgcagcgcgagctggtggtgaacctgatcatgtgggagatcggcaagagcctcgccgattcgcagaaggagttcgaccgcaccgtcacgtacatgacgcagacgatcgacgcgctgaaggagctcgacaacgcgaactcgcgcttcgtgatcgcggaaggcacgatcggccagatccgccgcacgccgctcggcgtcgtgctgtgcatgggcccgtacaactatccgctgaacgagacgttcgcgacgctgatccccgcgctgctgatgggcaacaccgtggtgttcaagccgccgcaatacggcacgctgctgttcgagccgctgctcgaggcgttccgcgacgcgttcccgaagggcgtgatcaacacgatctacgcgcccggcgcggtggtcgtgccgcacatgctcgcgtcgggcaagatcaacgtgctcgcgctgatcggctcgagcaaggtggccgaccacctgaagaagcagcacccgaagtcgcaccgcctgcgcgcgatcctcggcctcgatgcgaagaacgcggcgatcgtgctgcccgacgccgatctcgacctcaccgtgaaggagtgcctgctcggcgcgctgtcgttcaatggccagcgctgcaccgcgctgaagatgctgctcgtgcaccgctcgatcgtcgacgaattcctgaagcgcttcaccgccgcgctcgagcagctgaagatcggcatgccgtgggagaagggtgtcagcatcacgccgctgcccggcatgcatcgcacggcctacatgacggacgcgatcgacgacgcaaaggcgaagggcgcacaggtcgtcaaccattcgggcggcgagttcagcaagacgctgttctatccggccgtcgtgtacccggtgtcggaagggatgaaactgtaccgcgaggaacagttcgggccgatcattccggtcgcgccgttcgacgacgtcgagacggcgctcgactacgtgacgacgtcggatcacggccagcaggtcagcatcttcggctccgatccggtgcagatcggcgcgctcgtcgatccgctcgtgaaccaggtgtgccgcgtgaacctcaactgccagtgccagcgcgggccggacgtgttcccgttcgcgggccgcaaggattcggcggaaggcacgctgtcggtgagcgacgcgctgcgcgcgttctcgatccgctcgatggtcgcggcgaagcagaccgacagcagcaagcatctgctcgattcgatcgtgtcggatcacacgtcgaagttcatcaacacgggcttcattttctgagtacggcggccgcgcggcacggctcgctcactcgcgagccgcttgcggcggccgtgcgcccgcatggccgccgcatgcgctacacgttcgacaccagcagccgaatccccgccacgccgaacacgacggcgagacacgcttccatcgcgcgccggccgcgcacgtaaagccggcgcgcgccgttcatcgagaacacgagcgcatagccgccgaacaccaggcacccgatcacgaggcaacccggcacgacggcgccgtgcgacgcgcccgcgccattcgacgacagcgcgacgatcgacacccacacgaggatcgccttcggattggtcaggtgcagcattgcgccgcgtacgtagaaacgcgacagccgttgctcgcccgctgcgttcagcgacgtcgccgcgttgcccgaccatgccgtgcgccccgacttgaatgccagccacatcaggtacaacccgccgaagatcttgatcgcgaccagtagcttcgaccacgccagcagcgcggccgacacgccgagcgccgccaccgtcgcccagaccatcgaccctgaaatcacgccgagcgcaaacgcgagcgccgccttgcggccctggttcgcggcgaccgacatgatcgcgagattgctcggcccggggctggccgtcccgatgaaataggccgtgtaggccaacagcaggttggccgagaaaaagcgtggacgctcatgtcgaacctcgcagggatgatcagcgcattgttggcaaacgcgcgccgtctgcccatggacaattggccggcaattcgctgggccagttggacaggtcgtgcagccggctcgccgtgggcgaatccgtctcggttttgaaacacccgtcacattcgccgccggttttcgccggccgcggcggccatcccgcagcgccgccccggccggccgaacgcctgacaggcgcaggcggcaggcgcgcggcggcccgtttcgtcggcccgccatggaacgcgcgacgcaatttatccccgcgttacgttacatccgtgaagcatttcgcttcgccggaccgccccgcgcacccgacatgcatcgcgccgcgcaggtagatggcctcctcgatcgccgccacgatccagtaccggcgggactcgccgccctgcatcgccccgtcgctcgacattgctcaacaatcgccccgccgagctggtacggaacctgcgttccattcgggcgagacagccgcgccggtcatcgcgcggacacaaacccaccctcgggcgcgtccagcggatacgcccgaacgattcgcgcaagcaacgaggcccttcatggatgcactgcccaattcgtccgacacgtcgttccagctctttctcgcgaaactgctcgaacagccgttgcccgactggaccgaaaaacagcagatggaactcgagatggcgcgctcgctgtcgaccgaaatggtccacctcgccgaggacatgcgcggccgcacgcccgatctcgcgcgctgcctcgtgctgctccgctacgcgaaggtgctcgacttcatgctgacgtcgctcgccgcgcatcgcgacattcatccgcagacgctgcgcacgctgttccgcctcgcgaacctgaaagtcgacgatgcgtatccggcctgagccggcacgacgcagcggctgccgccggcggcaagcacggccacggcggccattcccgattcgcgcgcatgcccgataatctcgccgcatgagcatcaggaaccggacatcccggctggccggcgcgctcggcgtgttcgtgaaacgctacgggcgcaaggctcaaaagcatctcgacccgaacgatcgccgctacgatcgcgacgtcgagcgggcgatgcggcgcatgtcgcccgccgacctgtccgatctgctcgccggcgacgacgacaccgcgaacgacacccgggccgatttcgccgacgcgagacgcacgccgtgaacgccgccgacttcgaccggatctggccggccatctgcgacaccccggcctggtcggtgacgaaaggccagggcagctttctcacgttcgaattcgggcagcccgcgctgcatgtcagggagccgctcgccggctcgcccggcctgtccgcggcgtcccgggacaggctcgcgtcgcggcacgtgacggtcgccggcagcgggcatctgtggatctgctactgccactggtcgatcgcgctcgacggtctcgaactcgcgcacagcgaatcccgctccggcgacatcgccgccgccgcgcaacgtctcgacggacagatcctgcaatcgatcgcgccgcgcgcccagccgggctcgtgggcgttcgacttcgacctcggcggcaagctgacgacctggccgtacggcgacgacccggccgacgaacagtggcatctctacgaccggcgctcgggcaacgtgctcactgcccgcgcggacggcacttggtcgtacggcccggcgaacgcgccgccggaaagcggatcgcccggttccggatagccgccgcgcgcgcgccgcatccgcttccggcagcacgccgggctgatgccgtgcatcagcgtgacgagcggcccccaccgcaaacggaggtacaatcgcgcgccatgaacgcacttcgccgcttcctgctccggccaggcgtcgcgcgacagcttctgtggggattcctcctcgtgacgctgctgtcccgcgcgctgatgtcgggcgccgtgatgctcgatccggacggtccggatgcgggctcggtggtgctgtgttcgggccgcggcccgctgatcgtcgacgtggccgcgctggctgcccgtttcgatgccggcgcgccgatcacgccggccaacgatgcgctcgcgctcgccgatgcgctcaagcatgacgcgcacgccgacaacccggcttctgccggaggcggcgacagcctgtgcgcattcggcgccgcgctgttcacggcgctcgcgtcgttcgtgctgctggtgctgctgtttccggccgccgtaccgcggcgcttccggattcacgtcgaccctcttccgttcgtgcgatcgatcttcgacgatcgcccgccttcccgcgcgcctccctgttctgctgacggttccgcctagcggcctgcgcacatcgatatgcacgggcctgcacgccgttcgtctcatacgacctgattcaagcgttcatccgcctgcccgcaccgcgcgggcgacgccgtcatgcgcaccgtccgcgcatggcgccacgccgcccgctccgtcgctgcgtgccggcgggcgctacgcacgttgacgtccgccggcacgcgccggcgtggccgctcaacgaacacgaggagctgacaccatgtcgaccaccgtcgagcgggccctctcgcccgcccattccgcccacgcgggttaccggacgctctggcgctggcacttctatgccggcctgttcgtcatgcctttcctggtgatcctcgcgatcacgggcacgctgtattgcttccagccgcagatcgagccgctgctgtatccgcaccggctcgtcgtcgagccgcgtgccacgccgcgcctcgatcccgacgcgctgctcgcgcgcgcgcaccgcgatgccggccggcgcgacgccggtttccgtccaggtctcgaccgcgccggaccgcagcgcggaatacgtgttccggctgcgcgacggcagccgcgagagcgtgtacgtgaacccgtacgacggcaacgtgctcggcacgctgagcgtcgagaaccgcttcatgcagatcgaccggatgctgcatcgcaagctgctgctgggcaagacgggcgaactgctgatggagctcgccgcgtgctggaccttcgtgatgatcggcaccggcatcgcactgtggtggccgcgcggtacggcgcgcgtcgggcgcgcattgcggcccgacctgtcgctgcgcggccggccgctgtggaaaaacctccatgcgacggccggcatctggctcgcggccggcacggtcgcgttcatcctgacggggctgccgtggtcgggttcgtggggcaagaatttcaaggcgctggccgcgaccgtgaacctcggcgcgccggaaggcgcatggggcggcgcgtcggtgcgctcgacgcgcccgggtgccgctgcggcgcccgagcatgcacctgcgcaggccgccgcgccgtccggccatcaccacgaatccggcgagtcgatgccggggatggtgatggacgacctgccgttgccgcaaacgccctgggcggtcggcaacgtgcccgtccgcattcgccgtcggcgccgaccccggccccgctgccgctggcccgcgcgatcgcgatcgtcgcgggcctcggcgtgacgagcggctacacgctcgcgctgccgtccggcgcggacggcgtgttcaccgcgtcgtacttccccgacgatccgcaggccgagcggacgatctacctcgaccagtacagcggcgccgtgttgaaggacatccgctacgacgactacggcgcggtatcgcgcgccgtgtcgtacggcacgtcgctgcacatgggccgctacttcgggctcgcgaaccagatcgtctgcgcggtgttgtcgctcgggctggccgcgatggccgtcacgggcaccgtgatgtggtggaaacggcgcccggccggcaagctgggcgcgccgtcgcgcgaacgcggcacgccgccgatgcgcggctggatcgcggggctcgtgctgctcggcatcgtctttccgctgatgggggcgacgatcgtcgcggtctggttgatcgatcgtctgctgttcggccgtgcggcacgcgcggcagcctgattcgtcgcgcgccggcgcacgctgcgcgccgacgcggcaagcccgggccacggcgtggctcgggctgttcgcgctcgtgctcgcgctcgtcgcgccgctgatctcgcaactgcgcgcaagcgcatccgaatccgttggcggcctgccggccgcgccgatctgctcggcaaccggcaacacgcttgtggcgcacgcggaaccgcatgcacccgccgatacgcacttcgaccgctgcggctattgcggcctgctcgccggccatccgccgttgcagtacgcggcgttcctgtccgccgccccggccgggcggcatacgccgcccgcgccgccgatccccgccggccgcgccccgtcgaagcgctacgcgctcgccgcccgcgggccgccctcctcccgcgcctgacgcacctcgcgaccgcgtcgccgcacatcgcgcggtgccgtccgcttcgcctgcccgccctgccggtgtccgatgccgagcccgcgcgcgtgaccacgcgcggcggacggcgccgcgcatggggcgcatcgtgtccgtttcatcatcgtcaccccaaccatacgtacaacgacatgtttcccttgacccgtattgccgtcgcgctgtccggcgcgatctccgtgctctccgcgtcagccgcatacgcacaaggcgccgcgccgaccgacgcgccgaccgcatcgacgctgcccgcgatcaacgtcaacgcgactcgcgcggcggactcgctgacgtcgaaatcgaccgtcgacctgaagcgcacgctcgaccagacggtcggctcggtgggcttcgtcgatgccgacagctatcagaacacctacgcattcacgctgcgcgacgttgaaggacgtgcccggcgtgttcgtcgagaaccgctacggccaggagttgcgcctgtcgatccgcggctcggggattgcccgctcgtatcacacgcgcggcctcgagatcctgcaggacggcatcccgaccaacctcgcggacggcagcggcgactactaccagatcgatccgctcgcgctgcaggcggtgcaggtctacaagggcggcaacggcctcgcgtacggcgcgtcgaccctcggcggcgcgatcgacttcgtcacgtcgaccgcccacaccgccgacgcgccgaacatcgtgcgcgtggaaggcggcagctacggcacggtgcgcacgagcgcgcagatctcgcgcgtgatcggcccgctcgacttcctcgcgaacttcagcgtcaatcattcggatggttatcgcgatcacgcgaaagggcaatacgagcagttcaacgcgaacgtcggctaccggttcagcccggccgtcgagacgcgcttctacgtcggcgtgtacgtcgtcgaccagctgctgccgggcacgctgtcgctgtccgatgcgctgaacaatccgaccagggcggcgccgaacgcgatatcgggcgatcaggcgcgcaacacgcgcaccgagcggatcgccaaccgcacgacggtgaagctcgattcgggcgaactgcaattcgacacgtgggcgattcacaagagcctctatcacccgatcttccaggcgctcgaccaggacggctggacctacggtttcgcgccgcgctacaccggccgcctgaccctcggcgggatgcgcaacgacctgatcgtcggcgcgcgcttcttcggcggccgcacgcaggcgaaccagtatgtaaacgtcaacggcgacaagggcgcgcagacgctcgactcgacgcagacggcgttcaactatgaggcgtacgtcgagaaccggctgttcttcatgccgaccgtcgcgctgatgaccggcgtgaaggcgctgcactcggtgcgcgagtacatcgacaacggcgggctgccgcgcgacccgaactaccggtcgacgaacgcgagctacagcggcgtcaatccgaagctcgggctgctgtggcagccggacgcgaacacccaggcctacgtcgacatcacgcgcagccaggacgtgcccgacttcaccgacctcacgcagaccttctcgaacacgacgcgcttcacgccgctcgcggcgcagcacgcatggacgatcgagttcggcacgcgcggctcgcgcgagcgtgtgagctgggacgtgaccgcctatcgctcgctcgtgcgcgaccagttgctgcagtacacgacgaaccctgacgtgccggcggcgacgttcaatgcgaacaagacggtgctgcaggggatcgaggccggtgcgtcggtcgaactgttgcgcaacgtcaccggccgcggcgcgggcgacaaggtcacgctgtccggcatctggaacctgaacgacttccgcttcaagaacgacccgcagtacggcaacaaccggatcgcgggcgtgccgctgaacgtgctgcgcgcgacgctgggttacgcgcgtccgagcggcttccacatcgcggccacgctcgactgggtgccgtcgggcgcgtgggccgacgatgcgaacacgttgcgcgtgccgagctacgcgctgctcgggctgcaggccggctacgacttccgcaacggactgtcgctgttcgtcgacgcgcgcaacctgaccaacaagcgctacgtcagcgacatcagcaccgtcgcggatgcgcgcaccgcgaacaccgcgatcttctatccgggcgaaggacgcagcgtgttcgccggcatgcggtacgcgttctgatgcgccgcctgcggcatggcccgttacacagattcaaaggaaaccgaaacatgaagttcagctcgatgctgcccgccgccttgctcgcggccttcgcaccggccgggcaggcccaggaaagcgacgccgcgaacatcggcgccacgcttgcaccgattcgcatcaacgcacagaaggcaacgccgctcacgcgaccgctcgataccggcagccgtctcggcctgtcgtcgctcgaaacgcccgcgagcgtcgaacagatcgatcgcaaggcgctcgacacgcgcggcgacagttcgatcgtcgacgcggtgagccgcgccgccggcatcagcgcatcgccgcatcccggcaacggcggctcggagctcggcgcgcgcggcttcgtcggcgcgtcgtcggtcacgcagctctatgacggcgtgcgcccgtacggcgcgatcggcatcacctttccgttcgatacgtggtcggtcgaccacatcgacgtgctgcgcggcccggcttcggtgatctacggcgaaggggcgatcggcggtgtcgtcaacatcgtcccgaagaagccgacgcgcggcccgatccgcaacgagctgcaggcgggcggcggcaccgagggcacggcgcgggtcgcgttcggcagcggcggcgcgatcaacgacaagctgtcgtaccgcttcgacatcagcggcaaccgttcgtcgaactgggtggaccgcggcaattcccgcaacctgtcgatctccggtgcgctgcgctacgacgtgacgtccgacctgtacgtgacggcgtcgtatgcgcagggcttccagcatccgatgcagtatttcggcgtgccgctcgtcaacggcgcgcgcgatcgcgcgctcgacaagaagaactacaacgtcggcgacagcgacatcgcgttccgcgacagctgggcgacggtatcggcgaactggcagccgagcgacagcctgaacgtgacgagcacgctgtaccggatgaaaagcaaccgtcactggaaggatgcggagtactacacgtacctgccgtcgaccgcgcaggtccgcgcagcagctacacggaaatcttccacgaccaggagcagtacgggaacgtgacggcggccaccgtgaccaccgcgctgctcggcatgcgcaacacgttctcgacgggtgtcgagttcaatcacacgacgttccagcacgacaacaacgcgccctattcgggcacgtcgacggtcgacccgttcaacttcgatccgggcagcttcatcaacacggccggcacctatccgaagtaccgcagccaggcgaaccagtacgcgctgttcgccgagaaccggctggcaatcacgccgcgctggtcggtgatcggcgggctgcgctacgaccacgcgagcgtgaatcgcgacgatctcgtgaacggcggcgcgttcacgaaggtgttcgcgaacacgggctggcgcatcggcaccgtgtacgacgtgcagcccggcctcgccgtgtacggccagtattcggtcgcggccgacccgatcagctcgctgctgtcgctgaatgcgtcgaaggcgaatttcacgctcgcgaccggccggcagatcgaaatcggcgtgaagcagtcgttcctggacggcaaggcggaatggacgctcgcggcataccggatcgtcaagagcaatctgctgacggccgatccgctgaacccgaaccagtcgatccaggtcggccggcagtcgtcgcgcgggctcgaggcgacggtcggcgcggagatcgcgaaggactggcgcgtcgacgcgaacgtgtcgatcctgcgcgcgaaatacgacgacttccagcaaacgtccggcggcgcgacggtctcgcgcgcgggcaacgtgccggtgtctgtcccgcagcggctcgcgaacctgtgggtgagctggcgcttcgcgccggactggacgggcatcgcgggcgtcaagtacgtcggcaagcgcttcgccgataccgcgaaccagctcgtgatgccgtcgtacaccaccgtcgacctcggcctcgcgtggaagccgcgcaaggacacgacgatcacggcgcgcgcgtacaacgtgttcaatcgccgcttcgtgcagtccgcgtactacaacgagacgcagtacctgctcggcaacgaccggcggctcgaagtgctcgcgaactaccggttctgacgcggcgcgcgtgccgccggcacaggcacggcggcgcacatcaccgcgtgcctgccgcgcgccccgccatccacttgcggtagcgccgcgtctggcactgcgcggccagttgctgcctgaccagcgcacgcagcggcgacacctgcggatgcgtgcgccggccttcgctgagccgtgtcagctggaacttgacgacggccatgttggccagcgcacccagtgccttgttcttccaccggatcggctgcagcaccggcgcgctgtccttgccggcccgccagtcgcgcggcaggttcgggtcgatcgacaaagcggtcgcgatgccgaccatcgccacgccgctgtccaccacctgctcggccaccgcgcggcgccggatgccgcccgtgaccatcagcggcatctgcgcgaccgccgtgatgtcgcgcgcgaattcgaggaaatacgcttcgcgggccagcgtgcgcccgtcgcgcgcctcgccctgcatcgccggcacttcatagctgccgcccgacagttcgacgagatcgacgcccagcggattcagcagttcgaccacgcgcttcgcatcgtcggcgctgaagccgccgcgctggaaatcggccgagttcagcttgaccgcgaccgcaaattccggcggcaccgtcgcacgcacgtcccgcacgatatcgagcagcaggcgtgcgcgattctcgatgctgccgccccaccggtcctgccggcgattcgtcagcggcgacaggaactggctcagcaaatagccgtgcgccgcgtgaatctccacgccggtgaagccgcactgctgcgcaagctgcgcggcgcgcacgaaacgccgctgcacatcgtcgatatcggcttgcgtcatctccttcggcaccgggaactgcttcgacagcgcaccgagctcgagcggtatggccgacggcgcgagcgtcgtctggccgagcgccgcctgcatctggcgccccgggtgattgatctgcatccatacgtgcgcgccgcccgagcgcgccacctccgcccagcgacggaagcggccgagatacgcgtcgctctcgagcacgaccccgttcggccccgtcatcgcgcggccgtccaccatcacgttgccggtcaggatcaggccgacccgccgtcggcccacgcctggtacaggcgcagcaatgcgtcggatggcgcgtggttcgcatcggccatgttctcttccatcgcggccttggccagacggttcggaatcaccgccccgttgggcagtgtcagcggcgtaaacaggttcatggagggcaccctcgattgacgatgcccaacgataactttaaagtcaacttcaaggtcaagcccctcggagcaccgcatgaaaatcggcgaactggcacgcgccagcgcatcgcggcgtcgcgcatccgcttctacgaagcgagcggcctgctcgaaccggcccgacgccaggcaaacggttatcgggaatacgggtcggaagcgttgacgcggctcgcgatcatcgaccgcgcgcagcgcgcgggttttgcgctcgacgaaatccgcgcgctgctgccgcccgatctcggcgcgtggccgcgcgacgaactgctcgtcgcgctgcgccacaaggtcgacgaaatcgtgctgctcgaacagcgtctcgcgcagaaccggcaacatctcgagacgctgatcgacgagatcgagaacaagccggcgggcgaggattgcgcgggcaccgcgcaacggatgctcgaccggctgtgcgcacaggccgacgcaccgccggcgcccgtgcccgcgccggtcccgaggccgacgcgcaagcgcgcatgaccggttacactgcgcccccgacgaacaatcaacccgcgctgcggcgagacgagtcggcgcgtgtgtgccggctttcgcggcgcgacctccagacccgatccgcatgacgatctcccgcatcacaggattcctcgtcgccgcgctgctgacgttcggcatcggcggcacctacgccgcgacgtgcggcgacacgccttcttcgatccgttgcccggatacacccgatcttccggacgacatcgtcgcgcagcttcccgccggctacgaagcgctggatgccgcgtcgggccgcctgaccgacagccccgcatcggctatgtggtcgtcgcgcaccagcccgacgattcgatgcgcaacgcatcgctgcgtccgctgatgatcttcctgccgggcacggacgggcactaccggctcgcggcgcgcaacgacaccgtgatcatgaaagccgacgaaggcgggatgggcgacccgtatctcgatggcgtcgccgagaacgcgctcacgatcgaaccccgcaccttcacggtcgaacagggcgtattcgcggggccgagccactggcgcgaccgcgtgacgtttcgctacgacgccgcgcaccgcacgtgggtgttccatcgcgaagtcatgcggaactggcggctcaacgacgacccgaacggcgatgcgctgaaagccgacccggtgcgcgtcacgcgcgccgatgcggctaaagccgtcacgttcgaagcgtggcggccgggttactggtgtgattcggccgagcggcgcggaaccgatccggcttgcagcaagcagcattgacgaatgcatagctatacgaatgactctgcgtgcgggcgtgcttgcgggcaagcgatatgcgtggatgctgccgcaccacacgggcgacgtgtctgccggcacgcgccatcgttagcggccgtgcggatttccttacgtcgcaggtaatcgacgcgcgccgcccgcgccgcgatcatggctccatcgactcacctcacgtcacggagcccgccatgaccgcctacgccatcgcccacctgcacgacgtcgagatgtgcgacgacatcgtcgagtacctcgagcgcatcgacggcacgctcgcgccgtatgacggccatttcgtgattcacggcgcacggccggaagtgcgcgaaggcgtgtggcgcggcgacctggtcgcgatcgcgttcccgatctcgccaccgcgcgtgcatggtacgaatcggatgcgtaccggcagatccagccgctgcgcgcacgtcacgcgagcggcccgctgatcctgatcgacggcgtcgacgcgcggcaccgcgcgaccgacatcctgcgctgaaccgcggcagcagcgacgccggcggcgcttacgacgcgttgcgctccatcggctcgccgacgacgaacccgccgccctggaaccgctgggcgggatcgtcgtagtcggcggtcggcgccgccaccgggaacaacccggcgaactgctccgaactgtcgcgcgggcggaagccgaggaagccggccttcgtgttgtcccaccacttcaccgggttgtccgacgcgccgtacacgatcgcatgcccgacgcggttcgtcagcagcgagcagcgcacgagctcgatgaagtcgcgatagctgaggaacgtcaccagcatgcgcggattcttcggtacttcgaacgacgagccgatccgcaggcataccgtctcgatcccgaaacggtcgaagtaatagcgcgacagcgattcgccgaagcacttcgtcacgccatacaggctgtcggggcgcagcggcgaatcggcatcgagcacttccgtgaccggatggaaaccgatcgcatgattcgagctcgcgaacacgacgcgcttcacgccatgcttgcgcgcggcttcgtacaggttgtacgtgccggtgatgttcgcaccgacgagatcgtcgaacggcgcatcgaccgaaatgccgccgaggtggacgatcgcgtccacgccgtcgacgagctgcatcacagccgggcgatcggccaggtcgacgacgcgggtttcttcatgcgcggccgcgtcgccgagcgtcgcgatgtcgctgacgcgcacgacgtcggcccagtcggcgagcgcgccgcgcaactggcggccgaggttgccggccgcgcccgtcagcagcaggcgcccgaacgatttgcgcgcgccggtggatgaggcgttcatcgaatctccttgaatctgacctgaaatctgactggatcggaaaacgttttccaactatacgcgggagcgcgaccgaacgtcaatggccgaacccgctcgcagccatccgcactttcccgatatcggcgcgtggtcgcacggccctgttttctgccacaatccggcgttatcgaacgaaaacgttaccctccgcatgaaaaagtttccccgacgatccgcgacgtggcggcggaagccggcgtgtcggtcgcgacggtatcgaagtacgtgaacggcacgcagcgcttttcgccgaccgtcgaagcccggctcaaggaggcgatcgaccggctcggctaccgatcgaacccgctcgcgcgctcgatgatcaccggccgcacgcgcaccatcggcctcgtgatcctcgacatcagcaacccgcacttcacgaacgtggtgaagggagcgaaccgcgtcgcgctgcagcacgactacacgctgctgctcatcgataccgaggagagccaggcacgcgaacgctcgctgatcgaggcgctcgcgcagcgcgtcgacgggctgatcgtcagcacgcggatgcccgacgacgaagccggctggatgctcgacctcaacaagccgctcgtgctgctgcgccgcagccccggcctgccgattccgagcgtcggcatcgacaaccggctgtcgacctacatgctcgcgcgccatctgctcaatctcggccacacgcgcatcgcgtatctcggcttcggcaccgcgcgcgtgaacgacgagcggatccagggcgcgcgcgactgcctcgccgaagccgggctcacgctcgacgtgcacgatgcgcatgcgccgaccgccgaggccggcgagcgcgcgtgttcgcgcgtgatgctcgggccgcagcgtccgcaagccgtgatctgctacaacgacctgatcgcgctcggcttcatgaaggaagccgcgtcgctcggcttccggctgccgcaggacgtgtcggtcgcgggcatcgacaacgtgccgtacggcgaatacgcggcgcctgcgctgacgaccgtcgacatccagagcgagaacatgggtgagctcgcgatgcagaagctgatcgacgcgctcgcggggcgcaccgacgcgagttattcgacgttcgagccgcggctgatcatgcgcgcgtcgacggccgcggccggttgagtgccctgccccgcgcctccaaagaaaacgcgccgcccaagggcggcgcgttcgtttgcggacatgcgatgacgtgactacgtgactacgcgatcacgcctttacgcgtcgagttgcgccggcttcatcttcggcgtgagcatgtgcatcacggccagcgcgagcaggtaggccgacgcaccgatcgcgaacagcacccagtagtggcccgtgcgctgcagcacctggccgatcacttccgagaacagcacgccgccgatcgaaccggccatcccgccgatcccgaccaccgatgcaaccgcgcggcgcggaaacaggtcggacgccgtcgtgaacaggttcgccgaccagccctggtgcgcggcggcggcgaggccgacgatcagcaccgcgacccacaggctctgcacctgcgacacgaacgcgatcggcaacacgcagcacgcgcagatcagcatcgccgtcttgcgcgcgcggttcacgctccagcccgcgcgcagcagcatcgacgacagccagccgccgccgatgctgccgaccgtcgtcaacgcatagatgcagacgagcggcaggccgatgtgctgcatgtccatcccgcgcgattcgttgagccacttcggcagccagaacaggtagaaccaccacaccgggtcggtcaggaacttgccgatcaggaacgcccacgtttcgcgcttgcggatcagttcgccccagcgcggcgcgccggcgttcgcgttcgccgcgtcgagcgcttccgcttcgtcgcgcggctcgtcgtattccgcggcgagcgcgcgcgtatcggcctggcgatagagcacgagccataccgcgagccacacgatgccgatcgcgccgatgatcacgaacgccgcacgccagccgtaggccaccgcgatggccgggatgatcgccggcgcgaacaccgcgccgatgttcgcgcccgagttgaagatgccggtggcgagcgcacgttcgcggcgcggaaaccattcggccgtcgtcttgatcgcggccgggaagttgccgccctcgccaattccaagcagcgcacgcacgaacgcgaagcccatgaccgagccgaccgccgcgtgcagcatcgcggcgatgctccacaccagcatcgcgaccgcgtacgagacgcgcgtgccgagccagtcgacgatccgcccgaagccgagcaggccgagggcgtagaacgcggaaaatgccatcacgatgcggccgtactgcacctgggtccagccgatgtcgtgctggagcatcggtgcgagcaggccgaggatctgccggtccatgtagttgatcacggtcgcgaaaaacagcagcgcacagacggtccagcggtagcggctggcggccgcgcgcacggcgccgacgacggcagattgcatgaatgtctccgatgcgcggccgcgcccgtcgcgccgcacggtattcgttgaccggcgaccggcgccggggcggacggcggcgcgctgtcgcgcacggccgaatccgccgatcaatctggaaaacgtttttcaaaggataggtcgtcagccggcgccctgtcagtcggggatttcgatgagtcatctcaaattggtcgcggcaaaagagacgactgttttgcaatgtggcattaaccgtttttcccggattttcccgccatcagggcgagcgcacgatcacggatgcacatgtccgaatccggccaggatcggggccgggatggtttacagtcgccccatgcgcgtcgattccctcgcctgccgcgacgccgcgcagcacaaccccacccgcgagccacatgaaacgccctgccatcgcttttactctcgttgccggatgcctggcgggctgcgccacgcacgatctcgcccccgcgtcgggcgaagcaagtgccgaaccgccgcgccgcatgcggcgcgccgggcgccgtggcgcgcgtatgccgcacgtgcggccccttcacggagagatgttgtgactcccgctcacctgattccgagcccgctgggcgacatcgcggtacgtatcgaggacgatgcgctgacgggcctctacttcgtcggccagaaatacttcccgccggttgcgatcgtgaccgaagcggacgcgctcgcgacgccaccgatcgcgcgcaaggtcgcggaagaaatcgccgagtacttcaccggcacgcgcgaaacgttctcggtgccgattcaactgcgcggcaccgcgtttcagcgacgtgtatggaaggaactgctcgcgattccgttcggcgaactcgtgacgtacggcgacatcaccgggcgcgtcgggttgccgatgagcggcgcgcgcgccgtgggcggcgcggtcgggcggaacccggtgtcgatcatggtgccgtgccatcgcgtggtcggcgcatcgggcagcctgaccggttatgcaggcgggatcgaccgcaagcgtgcgctgctgtcgctcgaaggcgcggggttcgagcgcggcgccggcgatccggtacagcaggcgctcgcgttctgagcgagggcgggccgccgcgtcacgcgctcagcacgggccggcgcgcttcacgcttcgcgtacgcgccgggcgtcacgcggaatttcgcctggaacagcgcgatgaacgacgacgtcgagtcgtagcccagttgtgccgccaccgcgccgatcggctcgcccgcatcgagcagcggcagcgacgccagcagccgcaccgcctgccgccattcggtgaacgacagccccgtgtcctgccggaacagccgcgacagcgtccgtcgcgtcgcgccgacctgatgcccccattcgtcgagattgcgcgtatcgcccggatacgcatgcaacgcacgcgcgattttcagcagacgcggatcgcgcggcagcggcaccgtcagcggcgccgcccgcatccgtgcgatccggtcggcgatcaggcagacgagcgcaccgtccggccccgtctcgtcgtagttcaccggcaattcagccgtggcgatcaccaattcgcgcagcagcggcgtcatgcagaggatcgcgcaatcgtcgtgcacgtcgtcacgcgcgatcgccgcatcgagatacaggctgtggaacgcgacacaatcacgcgtcgacaccgcatgcggcacgtgcggcggtatccacatcgcatagtgcggcggcaacagctgccggcccgacggcgtcgacacctcgagcacgccgctcgtcgcatacatcagctgcgcccacggatgactgtgcgcgtcgacgctcgcgttgccgggaatctcgaacgcacgcacatacagcggcctcggcaggcgtgccatcggcggcaccgcgtaagggtcacccgattgtcccgccagcaacataagacgtcctccgaaggtcattgcacgaacgagcgcgatgctaccgtggcggctcttctttcacacggcttcagcccatgagcgctcatacccgcaccacccgcaagaccgtcaccgcgatccgttcgaccaagggcatcggcagcctcgtctcgctgaccgcctactccgcgccgatggcgaaactcgtcgacgaagtggccgacgtgatcatcgtcggcgactccgtcggcatggtgctgtacgggatgcccgatacgctgcgcgtcacgctcgacatgatgattgcacatggcgcggccgtcgtacgcggcgccgcgcaggcgtgcgtcgtcgtcgacctgccgttctcgacttatcaggaatcgcctgcgcaagcgtatcgctccgccgcgcgcctgctcgccgaaaccggtgcgcaggccgtgaagctcgagggcggcagcgagatggccgacacgatccgcttcctgaccgagcgcggcatcccggtgatggcgcacgtcggcctcatgccgcagcaggccaacgcgacgggcggcttccgcgcgcagggatggacccgcgctcggccgcgcaggtgttcgacgccgcgtgctcggccgaacgggccggcgcgttcggcgtcgtcatcgaaggcaccgccgaagcgctcgcgcgccacctgaccgaaacgctgacgatcccgacgatcggcatcggcgcatcgccggcgtgcgacgggcaggtgctcgtaaccgaggacatgatcggcgctttcgatgcgtacacgccgcgcttcgtgaagcgttacgccgatgcgaacgccgtgatgcgcgacgcgatccgccagtatgcgcacgacgtgcggcagcacgtgttcccggagcccgcgcattgcttcgggtatggcaagccgctgcagctgatcgaaacggccgacgcggccgcgtaatcgcatcgccggcgcatcgtgaaccgtgcgatcgcttcacgcgcgcttgcgcatcgcatgcgtgacccgcgcgttcgcctcgaatttcgcgcgatgcgtcgagaagaacgtccgcacgttgcggacgttcgatgcgccggtgaacagccggcgcgcgaattcgtcgtattcggcgacgtcggccagatcggccaccacgacgaaatcgggccccggcgacacgcggtagcactgcgtgacagccggctccgcgcatacgtacgcttcgaacgcgtcgtagtcttccgccgtctgccggtcgagactgatctcgatcagcgcggtgacggccgtgccgatcgccaccgggtcgagcaccgcgacctgccggcggatcacgcccgcctccgtcagccgccgcacgcggcgcatgcaggtgggcggcgacgacagcgcgcgctcggcgagttgcaggttcgacaccgacgcgtcgtcctgcaggatcgcgagaatgcgcaggtcgagatcgtcgagggtgatgccggccatcggcggctcctttcggtcagggtgtgaaatttaatttcaatatgatagacgatcaaccatccatttcatttgttcttatattttgaaatttaattccgtaagacggcctctaccatcgctctcactgatccagacaggacatttacggagcgcgatatgtgtggaattgtcggggcggtcgcccagcgggacatcctgccgaacctggtcgacggcctgaagcggctcgaataccgcggttacgattcatgcggcgtggtggtctaccgcgaccgggcgctggcgcgcgcccgcagcgtcgaccgcgtcgcgaacctgcagcgcgagatcgccgggcaagcgctgtcgggctacaccggcatcgcgcacacgcgctgggccacgcatggcgcgcccgtcacgctcaacgcgcaccctcacttttcgccgagcgacgcgaacgcgcgcatcgcgctgtcgcataacgggatcatcgagaactgcgatcaactgcgcgccgaactgcaggcgcaaggctacgtgttcgcgagccagaccgacagcgaggcgatcgcgcacctggtcgaccacctgtatgacggcgatctgttcgatgcggtacggcgcgcggtcgcgcgactgcgcggcagctatgcgatcgcggtgatgtgccgcgacgagccgcaccggatcgtcggcgcgcgcgacgggatgccgctcgtcgtcggcgtcggtgagggcgagaattttctggcgtccgacgcgattgcgctgtcggggatcaccgatcggatcgcgtacctcgagaacggcgatgttgccgatatccagctgcatcgctactggatcgtcgatgccgccggccagcgcgtcgagcgcgcggtgcagcgggtcgccgcgcatagcggcgcggccgatctcgggtcgtatcgctactacatgcagaaggagatcttcgagcagccgcaggcggtggccgatacgctgctcgatgtgtcttcgatcatgccggagctgttcggcgatggtgcgtggcgggttttcaacgacgtcgattcggtgttgttgctcgcatgtggcgggagttatcacgcggcgctcacggcgaagtactggatcgagagcatcgcgaaactgccggccagcgtggaaattgcaagcgagtttcgttatcgcgacagtgtgccgaacccgcgcacgctcgtcgtcgcggtgtcgcaaagcggcgaaacggccgacgtgctcggcgccgtgcatgtcgcgaagcaaagcggaatgatgcatacgctcgcgatctgcaacgttgcgacgagtgcgttgatgcgggaatgtgcgctgcagttcgtcacgcgcgcgggggtcgagatcggggtggcttcgacgaaggcctttacgacgcagctcgtcgcgctgtttctgctcacgctatcgcttgcgcaaatgcgtgggcggttgagcgacgacgcggagaaggaacatctgcgggcgctgcggcatctgcccgatgcaatgtcgaaagtgctcgcgctggaaccgcagatcatggcgtggtcggaactgctcgcgaggcgcgacaacatgctgtttctcgggcgcgggatgcattatccgatcgcgctcgagggcgcgctgaagatgaaggagatttcttatattcatgcggaggcttatccggccggggagctgaagcatgggccgctggcgctcgtcagcaacgagatgccggtgattgcggtggcgccgaatgacatgctgctcgagaaactccggtcgaacatgcatgaggtcagtgcgcgaaacggccgtctttttgtgttcgcggatgtggactgcgggttggtgccgggcgacgggatcgaggtcattcggctcaacgaatactacgggccgctttcgccgattctgcatacggtgccgatgcaactgctggcatatcacgcggcgctggcgcggggacggatatcgacaagccgcggaatctggcgaagtcggtgacggtggagtgaggtgggccgggtgtgctgaggtgtggcaacttcgaatagtttcacttaacgcgacgcgcgaagtttcacttaacgccccctacaatcccggcaaacgcccgctgggcagggtttaagtggaactgttccaacggcattttcgcgcgtccaaagcgtagaatgccccggaaaaccggtgccccgccgcgcaccgcattgagcccctttccgttcctgagcaatgacgagtccgtcagctcaggacacgtcggactgatgcggtcagcacttcgacaaccgaacattcgacaacgccaggcgggctgccctctgggtcataccttgcaagtactcgcgctgcgcctagtacgcaacggcagtatggtttcggtggaaggggaagaacggcgtttgactcatgcccggcctttcaccgcatgacgcaggtttcgccgaggcgcaccaagaacctcttgcactccggcaatgcataggtcgcgcactgcccgcagaaggcaagagcgcattcaccttgattgccttagcgcacacgcaacttcttgacgatgaacaccgcgcaggagagtacatgaagcttgaagaccgaatcgccctctctatcaaacgacgcaagagtgtcgttgttctgcgctcggaggtcgcaccactaggcagtgcctcgcatgtcggccgagtgctcgcgaagatggtcagtgacgggcgactgatacgtgtcaatcaaggcgtttactgcaagacacgtgtcaacagattcacaaacgcattggcacccgcagcaccgttcgaaatggttgccgctgaggtcgtcaaaaagttgaatattcaggtgaggcctggtcagctcgcgcgtgagtacaactctggtaccacaagttcgaagatttcgaaatcatcggctacaacccgcatccgaatatttccgctccaatcgccatctgaagcatcagtcgaacggaagttcacgaaagacgattgtttgggccgcatacgagacatcgagaccacatcgaacgcactatcgcagtgagtcatccggacctcgcggcggcgagcgtcacccggtctcgcttgtcccaagacgcgcggttacccttccgagcgacggacctatcggcggagcgtcaggtctggccaaagcttgcgcgacctcatcgggctctctcggaaacgtccccagaaaacccaacgaatcatctaattaggtcggacagaccggtgacggtgtgccgcaccagttccgttcacgacctcgttctacacgacagccgtcgcaatgttgccggccgtgtcgcagagtggccttagtcctcaaggggcttggacgcagcttgcagagctttgtagcgctatcgcgcagagctgtagcttccgcatcactgagagtagcctcaagtccgtccccgagcaccgtgagcttcaaagtgaactggttacccgttcgggtaagcgccgcatttttgtgtttggacgtgtgacgatagcctttatttcgcgctcgtcgacgtacaccttaacgccaaacaggttcactctggcgaacgtcatgccgctctcagacatgaggtcttccacttcgagcagtcttccacgcgcgttgcccaacggcggctcgagtcctaattctctctcaacgtttgcaacactcaacgcggcctctcgagcaagcgttctaacaatgtctgacgagcgccggtctcgaagactcttcttgagggccgcggtcagttgctcgaatgtgtcgacgttttgatagcgcagcttttcaggcaggctatacgtttcgacgaccgccggaaacgtacggaatgggcagcgaactcgcagcaactcatacgctttctgctcctgtagccgaggccacagcgagaacttccagacgccgacaccttcgatgttctcactgcgaatccgaccttgaacgaggttgcttgtacgctctgaaattccgattgcttgcgcgtcgagaagttcgctgataagagaccatgcgtcctgattcgggacgtcagccagtagtgaatctcgcggccaaagattttccatttgtattcctttcatacgtcgagagacaccaccactggcaggtggtcagagatattttcgttaatacgtccgctggccctcagaaggttattattgcctgtgcctgtcaggacgcgcggactatcattgatgaaacgctccatcaaagtagggcgaacaatcacttggtccaacaactgccaccttgttgagtcggctttatcttgaagatagtatgagccgggttgattgtcggcagtctggttcccgagaagccccacattggattgtagaagtattcgtagaccgttcccaacaccgtgcggcttccctggccgcgattttcttgcaggcgactgcgttcaatccttgaggagcagtcatggccggtccatagggtggcatgttgaagtcgccaatggccaatgttctcgtattcgccgccgccagctcctgttgctgcatagcgcgcgtcaactcagctgccacgctctgcatcaagatgacctgctgcgcagttcccactggggccgtcagatgcacaaaccagatttgatacgccagtgggttcgcacctacaactctcgtgacggtcacgggctggcatccagcgacctgggcaccaatttgcacgctgccttggtttaaatttgtcaataacacgaatcggccgtctaccgaggtgtgatgccaccacggtcccaggttcgctccgttgagattggcaacaatttgagctgcgttgacgttggtcggctcaccgagacagcaaaggacgtctccctgatggccaggaagagccgtgccagtcgacagattccttataaggtcttcaatgtgaggtgaagcaccttgattcttatgtacattccagaacgcaattgcaagcatatctgctcttatttggttttaggcacacaacggctctatcaactgcggcttttgtcgcttcaaaaccgcttatacggaagtgcgcagccaagagtcacaacgtcaccgctaaaacaatcatggtgccagaacgaacacaagataaccaacacattcccgcgtcgttgccggcacaatacccgtaaaccacctattcacccgcactaatttagagcggcgagctctccatccagggagagctcccttcattcgcgactctgcacgacaggcctctcgactgccagatgacggcatcgagtcaccgatggcactcattgaaggcgacttttgatagccgcatgcaccccaggcacgtcaattctcagatgagcgtcgtctacgagatagacatccttggcactttcaaccttcataatgctcgattcggtgattagagacgggtatgtcataacagcaacctgctttgcccccttatggacaatcaaagccatgcctttatctgcagcgtcgtcacaaatgaatccgtccagcaccaacatttctcgaagggcccgcaattgcctcacttggtcatcaaacggtgccggcctagggaccgcaccgtacatagcatatcgaaggagactagatgcaagtcttctatccagcagcggtttcaaatgctgattgtggaagtggtcaaggcattcagtacatgaggtatcgcacgagcagttttccagcaactgcaaggttgcgtcgagaatttcgccaaggtatttctcagccaattccgagtagcccgcgcctccggccaacgtatcgtaaaggtacacatccattacaacatcgccatctgcgcctgccttaggaagcaaacgatgtccagcgccaaactctgtcgcatcgaggtcaagttgtggatgtcgacttgcagccaatctcagcgcctctgcaatggagtacgcagcactctctagcgtcctcacgactcttctcgacgacaggtcggacacaagtggcgtcccaatttggaagcgaagtagcaccaaatccgtccggaaatcatagccgagaaacacactctcaaactctccattgcactcggtcggcacctgctttccgttatacagataagggcgtctgtgcttgcccacacgtggctttatgccatcgaacacgctcgcgcaaccgcaatcggagcaaacttgaaaccccttcgactccccaccttgcgtcagccccttattgaccgttaggagtcgacggtccgtggcgtgcgtatagaaaattcgctctccagcagacttaaatgcaaactcctcggcgttcgtgggctgcggaaactgtgccatcgtcgcgtaagtaatgtcttgctctcggtcctcctccctcaactctctagcatcctccggaccgaaaacctctggtgtaatcatcttttgccgagagagcgtttgacggcaaacagggcatgccaccggaattccacccttggaattcgggtcatacacgaaggagcaatcggtgcacgccacgagctcttttgaattcttaaacagcttccgagcgcgatttacctctccaagcggcgtactcgcgaacacaccaccagagcggtatgtcgccttgttgatgacgacgaggcgacctggcgcatattcgctgagtgcttggcccgtcgactgttgcgggcgctgcagaactcgaatctcccggctaccacgagcattcgactccctttttcgatttggaagctacatagttcggtaggaaatgcgtaggttggaagcaagccatgaaaaacaggaattccaaaaggtctgcgtgttcgtctacagcgtccgccgcaagcgaatcgccttgctcatcgtccaacaagtctgaatcgtccgcggtctccacaagcgcggtactttttagctcggaaagtcttctaagaaggcgcgcggcaacttctgacacccactggtccagggattcgaccgaaatgtcgagatttggaggcagccatgaggcaatagcctcacgcagtgggtgcggaggcgtgacgatacgctccaagacccatcgctcaaacgaactaagatttggcgactcggtggcggtcccctcgaaaagtcgcgggtcaacccaagagatttttgcaatatcgcgcttccggttccctcgcgctgtagttccgtgaaaaagtctggattaggtacgcgtgaacatgtcggcgagctatttttcattctgaaccttgagttccggtgaccttggcgtgcccctaaccatggaaggagggttgagaaagtagaagctatcgtgcggtccattctgagaataggtgaccaccgatgaaaccgaagctcctcgccgcccggcacgcccagctctctgttgataattttcacgctgcggcggaacgtttctaagagcaactgcgacgagagaaccaatgtcgataccgacttccatcgtcgtcgtgcagcttaagacgtcgatgggtttctccctatcatcgagaagaatgtcttggaagcgaagctcatgcttttcggtcgtcgaatggacgctacgatggtctcgatttgacagttgcgccgtatgctcctcaacgtacaaattcgctactttcccattcgtcgaaagtgcttcgatgacgggatgccgccagtacccctttcgcgcgacaagatattggtcttgcctcgggtccgcttcgcggacatctgaacctccgcagctcagacagaaacctttgaacaacaccggggacagtgaagtacaggcgttgcactgaaaccatgtcttctcaaggtctacagtcaattttagagcatttggactcaggaatagaccacctgaatcaacagccaacgcacttgacatgctgctctcaattttcttaacagcctcctcagtaaatactccatttgttacgattgcggacctaaatcctgagaaaaatttcccattacccccaacttggacgggaaatccatatgcttttgttctagcgtactctggaatatctgcatcaaaagcgaactcgaggagcatctcatccatccacgcaaccgcaagactgcgaatgtcctcttcggtcaagtgaaattcagctagcgccgtaacaagcttcttcagcgcatgccgacttggctctacgtagcctacggttgtacccgataaggagtagtacgagccgcacagcaacttcaacagcgcgactttgtatctaaatggtggctgaccagggtcgtatggaccttcgaacgcatcttccaagctttcacagttagacttgaatgtgtccacgtgcaagtctatcgtgtgcgactccgtatcgaacattgagagcttgcgttccgccagagttgctatataggcaagatagaggctactggttgtcggtttgggttcacgctccaacgatgtcagttctttaacggcaagcgcaatggtttgccgaaagaggtcgagctccatatcccgcggcatatcgcgcgcgagtcgcgctgctttctgtcgaccatcggagaatatgagtacctttttccctcgttaggaaatcggtcggcctttgcctttgatgcgggttgatatcgaatctgccctcggaccaaggtagcaaacggagcctcacctttcgtaacgtggtccataatttttgacggttcatctttagatgaccttgttttttgagcatgcgggacagacgtcaaagctcatcgccttttcagcgaccacgtccttatcgggaagccacaccgaccggaatccgtcaagcgtctctggccgcttgccttcaagacgcccagtcgaaatatgcaaccaatattgcaccgcccttatccccggtcgcaatctatcttcgacatacatctcgacttcgtacaaacttcgctctgaatccgaggtcagcgacttgtcgggttgatgccataagaaatttttctttgaatcaacccaacctctaataaatgacgctccacaatcgcgatgtgtcatatattcgaagactcggccatggttttcacatccgcatgaaatcatcggtttcgtatgaaacgaacctagaaccgtgggcgtcctattggccaacctaagtgtgcattggggtcgatgcacgcgtacaaacctggcagccctctgaagaaaagatgaagccgcgcggggagcaaaggccgaccatccttcatccggcgcgcaaacgcacacagtgcgagcagggaatcaagcgccgattgagcttcagccgctgaggtgtttggaaatatttcggcggtcagttctgccagactggcagcacgtcccgatgcaagggaaattacgagttgcgcaggtccaaacgtccaaagatgcttgaaaagatagtcacgcagctcgtccgccccaagaggcggagcctcccatccgaaggccctgccgatgtctgcaaccaccggtgccgcccctctggcttaacggcgtatgacgacagtgccgattggtcgaatctcgcgagcagacggctttcgtctgctgacgccgcagcagggtccggacgcgcctccaattctcccgtaacgacaacaaactcgtgtccttctgaggcgcctgttaagtcggtagcaaacgccataatctcttcgattgccttttctccgctacccaaactcgcgctagtcaagataaagcgaacgcgactccgactgactccgagtcttgcgacgagcctccgaataagcagggcgacttcggctccgcccgcgccgcgatacatgtgagcctcgtcgagaacaacaattagttcgtttctctcatcggatttcagccagtctgcggtctgctcaaagatggtgcgctcaattgggcgcatgagcatgtattcgagcatcgaatagttcgtaacaaggatgtcagggcactcccgctgcatctcgtcacgggtcatcaattcccggtcgcttggctgagtcttgagtcgctggttccagttaggggcaggagcgagttgccccttcgacttgcccctagaaatcgttcgctccccgacggcgctctcgccatagaagcctatcaggtccttgcttggccatctcccgatagattcgagcttcgccttgtcttccggggttgcctcaagtttgctgaaaaactcatcaaagaggggcgcgatgtgtgtggcgtccttcgtatcacttcgaacgcccgggtacggagtgcgcccggtgtagctcccgaagcggataggccgcttacgggaaccgcgaatcgtcccattgacctcttcattgccaatcaaacgtcgaatacgagcaacttggtcattgaccagtgcattcatcgggtacagcaaaagcgccctaaagcccggcagtgctgccgaagcaggcctctccgcgttctctattgtgagcgccccaacgattggcatgagaaagctctctgttttaccagagccggtgcctgtcgccacgacgaggtccgctcgtttgtcaccgagaaaatccgtcaaggccttgcattggtgcacatatgggtgcgggaatatgccaacgccttcgatttttgaaatcttagttagcgcatctttagcgaccttcggtatcgtcaagttttcgtaggattcaacttgagcgtaaaccgctgttgattcgacgtacgccttctgagcgatgacggcttctcggtctagtaaaatcgacctctcggcgacaagtgccgaatccttgatgtggtattgcgcctcaatgtaacgtttcagttcactatggaggccggatactgtttgatgtacgccttcggaggtgttttggtcatcgcgcatttgactagctcgtcctgatgttcacgttgtagcccaacgcttcaagggctctagcgataaagggatatagttttgaagaaaagcagtacttccgtggccagaggtcgctgtcccctagattgggagacctccacccgagatagagaaatttgctctccggctcaggcaacggccagaatagcgttacggtgcaatgttccccactgacatcgcattgcagcgtcggacgcttactttcattcccaaccaaaagcggctgcaaccgccgcgcttcctgtctgtcgatttttgctagagactctacgacagaaagattgtgcgaggtgctctttacagagcaaagaaagtattgaaacgactcatttccatagaacgatacaaggcgtcgagcgagtcgatgtccgtaagggcccgtaaatttagcgatgggtctccaaccttgttcgttcagaaccaagagattttcggcttcatcatcgaggggtttcgcgagctttagcgagtcgataaacgctgtactccacgatgtaacactctcccgagccagtcctagccagctctgcagcgtttgctctgacacaaactcaagccctgaggcgcaagtgccgcccgtagccaaaatgcgtgctctgcccgcttgctctatgttcttgcgcacatttttggcagtaatctagttgcgccgccgccgatgagaagcgaaactttttcatcgatagctatcaatcttggaggtgcggcagcatatcccccgcagtcgaccgccatatctcgctcaaacccaccatcgcgtcaatctcatttgaaatcgacaactcctggccgccctggtcagtgatagcaaatagaggttctacccggcgtcgaatctccatcgccagcttttgagacgagacctcggccagcccatcctccgcgttcgtaatcgacgccccatcgacagcacctcggatgtgctccgcaatcagcgtgaccttggttgcttctggagcgcctctgtacctaaattccgcctccagcgaaccccagagcgcagcgaatgtgattgcttcgaatctcattgaatcgcgtccgacgctgcaacgagcgtttgctcgacaacgttctcatcgagccaatcgccttccgtcttagccaacagctcgcgcaaaagctcattcttcatcccatttgcgcgcgcccaaggaagcaaccaatgcttcaagaaacttgcggaatgccccacttccatcagcttttctaatctgcgaagaataagtagagcattgcgtgcagtgcgttcccaaagcttcatcgagaagctgaaactcggaagagctcgtatgacgtgttcgatgtcttcgtctgtctttgccggctccaccaattcggtccaagatgccgagttaagccgtccaattgttgctgttgtgcgcttattggctcgcccccaactcagtgaatcggaatcgatatttggcccaagacagcagaactctggaccgggggcaaaacaccagagccgcccacaaacgttgccatcagaggcacattcgatatcgaccccttgataccgagttgcatctttgcgacaactgctgttagtctatctccatacacttcgaatgcagacttattcgcgccaaatatggctatacacccggcagccattccatcattcgacactctagaaagtacgaagttggtttcactaccatcctggagccctagcggtactcgccatgagagcatcgggctatcactcaatgcagcggcaacagcttcaacaagcaactcggcgaatgacccttgaaactggacaacctgtcctgctacaacaccggcaagcacagttgcagcgacaagtactgcgtcatccttgcggacaccaatagaggacaaattcgtcgtaataacgttgagtgctgtctttgcgtcattgatgggtgtgaccgccacctccaattcgtcagtcgtaatcgaatggggcgtgaactgcacatcggggatcctgttcgggctggtcacaatcggcaccgaggcatcttttatcgtcggcgtgtcgatgcgttcttgtaacgatgtaaggacgttttccagccgtacgaccgcctcccgattctcagcgacgctcgatgtcagattcgcagccttctccgtgatatgggcaaatccggatttcacttcttcagtcgcaattgacagcctgctctctagtttgagtacttcctgctcgaaggtccgagccaactcatcatttcgcggctgcgcattatcttgtcttgactgaaactccgaaaactcggcccgaatcttgggaatttgaccaagcaaatcaacaagcttgagtttcaagctttcggattcggcacggattgtgtcggtagtgcttcgaagctctgcaatttcgctttcgcgcgactttagttgcctttttagggattcgacctcggcaggaatctttgccgccttccttgcctggtccagcacgctgcgcgtcggtatccaactgaggtcggcggcagacttatccgtcagtgcgaacccactgaaagtcagaagccgctcaacatcctctcggcaaacggcgaggttttgctccggaacaagcttccttatgaaagtctcgactgcttcgcggtcgtcgacgataggttcgtccggagagcctggaaattgcgactggaatcgttgtttccccagcttagccaggcaaagctgaaagcagtccactctgcggtatgcgccttcgaattttggttcggcacctgagtgagtgcagcgacgaatcttcgccccctctccttaagcgcggactcggagtccgggcgaaacccggtgaccgattttatacagccatacgcaactcttctgtcagaaattggaatttccgccaagaatccagcgatttgtttactgccgagttctgctattcttttttggcttcctgggaatatgcccaaagagtcctcgagtctctcgcattcattgtttaaccccatcagcatagcgggcaagctcacgctcaagatatcgtcctgttgcggcatcgcccttcgtccaacgacttctattaaataagcgaacaagttctgaatctgacatacgcacgtcgggccgcggccaaacggatgtcggattcgactgaaaaagatacgctttcaacagcgctcgaacttgctctggtaactcagcggcacctacagctctctcgccatgagccaccttcaatatcgccggcagcgagacatagccgaaggcaccaaagtctacaacgacatctgtatcaaccttgctgacggcatcgacgaatagggcaacatcttcgtcgccaagatgaaatccgttcttcgttcccgcgacggtcttattcgtagcgcatatgcggtgctcgatagccgtgtctcccagcccaatacgtacgcgtccttgagcagcacgaggcatggaaacataatctagtttggcgtagccgtgcctgatatccaaaagcgcctgagtggcatggcggctatgcaaaggtgtcgacgtgctgacaccgtcattggtggtgacactaagcactactgcggcattcagagcgggccagggtgtcgcaaccggaagagagaattcaacatcaagcatcgcgccggacccactcgacgtcaagaagcgggcagttggtttaccggatggttcataccggaagaagggcctcacacccggaattccccggcggcacgctcatcaccgtcgcagcgaacaaatacgctgactgcttgacgaacatcaatttcgtccaaggcaaggacaattgcgtcatctcgaacagactggattgattggctcgttattctgtttgatattggtggccaaacttgaacaagattttgaatcttgtgtccagcaggtagttgtagattagccttaatccaatccacactggcctgtgacaggaacttgggcatgaatacgagggccgcagagaagtcctccctcgcctccaaggtttcacattcccaatcaaatggaaactgtacggcattgtcgtttcgccaaacgacggcgtatgtcctgccaccatcaatcttttccgcgcggtgaaaaagtgcatgtccggctcgcccaacggcagaaaacaccgtcatcccgactctacgcaagccttcgcaatttctaccttcgaatatggtcgcttggctgtgaggtggtgcggcggacagtatgcgatagggttcatgttgcggttcgacgacgaccgtgtagtttgaaagtcggttaccggtcaggtcgacagccgtttcgcgtcctcccacatctatcaagatgtgaccttccgaaacgccctcgacgccgaggtcaagttcaagtccccaagacatggggcgcgccgtcaaatatagacgtaacccaagccgcagttctccgggtcgaccgatatggtctgcatgtgcagcgtatgccgccgtcgtccggtaaattgattgtacgtagagttcacactcttccctggcaacattatggttgtgcgcgaaatgggctgcccgtacagaacctgctcttagatgaaccggctcatagcacctcgggcaaatatacgagccaaaggaaacctcttgcgcagatgaagcgctaatgagcttacgcgtccacttatcaagcgcggcgtccaattacagctccccgtaggtctttcatgttacgaagtgccttgtgctatgcggccctcgcgtttatatccgtttgcctctgccggtatgaggctttgattagctccggcagttgggcggcgtcccaggcacgatattccggccgagtagctgctcggcgcgtcagccatctttcgatagcgagtgctccgacttcgtcaacagacaacaaccgcttgatatcaggccgccccttgccagtgcaaagtattctagtcgcgttgtccgccaaaagcgatatgaacacctcgcgctggattccgtgcttcaataggtcacctttgaagcctagggctttcagcgcgctgcgcaacgttctgattcgccaattcgggccttgcccgaaagcatgcatatccggtgatacatccccgaatcgcgtaagtagtcgcgcatatcggaaaaagggcgtctggaacgtggaaatgcccccaaccgccgctgaaaccaacgctctggaagtatgtgacgccgtccagcttcaggcggttatatagcgaggagcgccccatagacgacgacgtcgtcaccgcgagaagtcgtgcgcctttctgttcgccggagatgatgcctttgcatttccgtaatacttttgaaaatccctgtagacgtctgtgctgcggatgaggcaggcaatcatcttgccaccaagcaacatgttatacggcggtacggcaccaaggacgtaagcatccatcaagttaactagcctcgcagcccggtcgtttcccgtccatccgatgctgttgtcgcggacagataggttgaaaactgggtcgccaatcgcaaagatgccaatgagcttgtcgttcgagtcgtcccaaacgagatagcgcagccggcgtccaaatccgttcgataccggcacggaccatgtcagcgtcgcaagtctgaataggtcaccctgccacgtaccgctatctacgcgttcaatccttactcggattcccaccgggtcaacttgattgccggacgcgaagtatcgctgtagcagcggcatctttgcggagacaaattcgcgctgagatttcacgatggcagctcgctgaggagcatggagctgtctgattgtctctttcccgacatcttgcaagacaagattgcctgtctgtgagcgcgcgtatccgagagatgacaggtgccggcgcaacctccgtttgagttgtgcctcccttacgttcagctcgagcaacttagtcattgttctgtcggcagtaatctatcagtggtcttcgtggccgcaccggcgcgacgtcactatgttggcatccggcggtgctagcgccccgtgcgccatgcttccggcactggctgagaaatcccagtattgtaatagtcgccgcccgagagcagcctgcgtgccaccaaaagaagtcgacgaagtctcagcttccgcgcttgcctgcttacccagtcgtgcgaagcgccctatctcggccgttcttcgcttggccttcgtcatcgaggaacgctcccagttggcctcacaacttccgatatggccctagggcgcgtacatcgacaccttgtgcaccgaaggctgatacaaaaaggctgtacagcgaaaccatgccgtccttctctcgtgcatcaaaccgacccatctacatgccagccctctgcatatcgtccggtcttacagaaacttgaacaaagcaatcggcgtcggtgctagctgtacgaaaacacaggctgtatgtacgaacatttacgccgcactacgccttatgcagcgagggttcagcattactgcactttccgtaaaaagtacagtacatttggggccggattacctcagacttttctcatttctgttgagaaaggttgagaaaacgagagagctatcaccccatacctttcgcggcgcacggttgtgtctgtcatattgctcacatagggtcttccctatatgatttcgctcggctctgagagaagccagtacaaggaaaatcaaatgggagcgcaagaccttatcgcgttaatgaatgccggggtattccagtctgaccgaatcgtgaaactggacacgcccgcaggaccgaatgtgctgctgccgcatatcgtggtgggcaccgctagcctcggcggtaattttgagatagccgtcgatgtggtttcgctgcaggactcgctcgagctgaaatcactcatcgcgcagccggtcaccctttggactcagcagtctgacaagacctaccgtccacgacatgggtacgttcacacggcacgccggctgggttccgacgggcgactggtcagcctgcagttgattttctcgtcgtggcttcatttcctgaagtttcgcaaggacgcccgcatctttcaggaccagacagtcgagacaattctcgaaacagtctttcaaggtcatccgcaggcacttggggcctatcgcatcgatgtgcagaaaccctcgccggcgcgctcgttctgcgtccagtatgaggacgactggaacttcgtgcaccggctgatggagtccgaaggctggttctattacttcgagtacgccgacgacggcaaatctcataccctcgtcgtcacagacgacctgtattcgctcaaaccgcttgagcctgagcaactccggttctatcgagctggcgtcacgcgtcagcccgacgcgctcgtgcactggtcgggcacgcgaactcttcagagcacatcgtattcgacaagtacgttcgactataagaatcccgaagcgcgcaaggaaaagtcattccctaccgtcgcaaaccagggcgacctgccgcagcaggccgaggtctacgagtacaccggaccgtacacgtacctggaggatgaccgcggcgaccagcttacgaagctgaagctggaggaatgggagtcgcgcgcgaaacgattctacgcggtaggcagcgcaccgagcattgatgtggggcactggttcagcttgttggaccatccagagcacgaccgggatagcgccgaggaccgcaagttcgtcgtcgtcgaaacgaactggtacatccgcaacaatctgccggtgggcgaaagtcgcccctacccgcatagtctggacgcccgtcttgccgaggttcgcgatgctcacgatgagtcagcgtcggcattcactgtcaaggacgccatgggcagcgagggcttcttcctcgttgaggtcgaagcgcagcgtcagaaggtgccgtttcgcagcccgttcgagcaccggaagcccgtcatgcacctgcagacagcgaccgtcgttggccctgggaatgaggaggtctacaccgattcactgaaccgcatcctggtgcgcatgcattgggaccgacgcgagggtcttggagcaacatgctgggtccgggtcgcctattccgacacgggcggcggttacggcagcgtgcatgtgccgcgtgtcggagaagaagtcaccatcgattgggtcggtggggattgcgaccgccccattgcgacaggtcgcgtctacaacggggcgacgcagccccgctggcactcgaatggcatcctttcgggcttcagctcgaaggagtacggcggtgggggctacaaccaacttgtgatggacgacgcgacgggccagaaccgattgcaactcttctcgtcgcaagctagctccatgctccacctgggatacctgattgcccaggacggtaacgttcgtggtaactacctgggaagcggtttcgacctgcgtactgacgcctacggcgccattcgcgccaaccgcgggctattccttacgacgcatcccagctcgggcgccgcgacccaacagctcgaggtccagcaggctcagcagcaactcgccggcgcgcacaacctggtcgagtcgctttccgatgtcagcacccagcaccatgccgaaagcctgaaagcgggccgagatgcgctcaaggatttgacggacgccgcgaccgacaatgtccaagggcaaggaccgggcggcggtggtcgcacggcaggtggcggtactggctctgccaacgcatttaagaaaccaattctcctggcagcgagcccggccggcatcgcgctatcgacgcagcagtcggtgcacctgagcgcggacgcacaggtcaacctggtcagcggccaaagtacacatctcgctgccggcaagtcgctgctcgtgagcgtcgccgagcgtatcagccttttcgtccagaacgcaggaatgaagctctttgctgcgaaaggcaaggtggaaatccaagcacagtcggacaacatcgaaatgaccgcgcagaaggcggtgaaggtgctgtcggcgaccgagaaggttgaagtcgcggcaagccagggtgtcctgctgacctctggtggcgcgtacatccgaatccagggcggtaatatcgagattcacgctccgggcaagatagacatcaaaggagcgcagcatgcgttttccggccccacgagcgcaccctacgatttgcccgccctgcccaagggcgacctgcacaacaagctcgagttgaaccttacggacgacaacctgaaggccgtgcctcaggccccctacaaagtcgtgttcgagaacggaacgaccttggccggcaagctcgacggaaacggtcacgcggtcctgcgcgacgtgcctgacggcaccgcgaaggtctttttcggcgaagacgcgcggccgttcaacccacaaccaatgcccgcacccacggagctcgcacagcctgatgttctcaaagaactgcatgcagccgggcacgagggcattacggaggaaaacctctacagcctgttcaataaattttctggccggccggacgtgaaatgaacgaaaacgaccaacaagcaatcgaagaggccgtcaaagagattggctggtcgatggcgaccaacgccgtgccattgttctacgtcgcgcagaacgtctacgacactacggaaagcgtctggacggtgtggaacgcacgcgaaagtgcggacgagatgacgaaaatcgaggccggcatcgatctggtgttcgccgtcgtggggtgggtccctgtcgtcggcgccggcgtcaagcgtacgttccgcctcgtcaatcacaagtctgaaatctatggcccactgctgttcgacattctgcgactggtgctccagcaagcgcacattcaaaccagcccggacgcgttgattgacaagctgttcgacgccaccggcgtcaagaagtatctgaccgaggcgcgcgaacacatccagaagtcctggctgtatcgcgagatgccgtccgcaatgcaagtcacgtttatgcaggcgctgaccttcgtcgaaacgaacctgccttactggctcgcccagttcgtccagcgcaagctgctccactggcgcaagaagcagccgaattcgtccgcagtcagcaccctggaggagcatcggaccaccgaaaagcctggcgcgaagggagaagaggcgaaggcgggtcatgaccgcccggtgccaacgccctccagggagtggtgaacgccaagctcgcggtgaccgatatcacgaccgaaatcactggcatcctgggcgaacatatcggggactactactgctatgaaaagctcaagtggggcaatggctggcagactcacgacaaaggcccgagcggcaagtggagcgagcagcctggcctgcgggtcatgggcaagctcaatgacaaaggcaagctcaacaagctgttcgaactcaaggcacgcggtcacggcatcgacggcgtatggcgtgcggcaccattcagcaaccagatgaaggactacgccatcgtcgaaatgaaggcatcgacgacgaagcggaagctgaaggacccgaatgcaaagcatagtatctggagcaaactcgggacaattaaggatgaggtgcggcccgccgcagacgaccttctcgaaccgcccgatgacgagggtcccgctgttcccactggtggtggctcaggtaagccagggtccggcaaacccacgtctggcggaggaggtggaaaacctccgagcaccggggcggaaagcctgccgccagtagcgacgtcaaggcccaacggaagccgcaaaacgaggggctgctgcgccaggcgaagcggttccgacaactgagccagtggctccgaaggacccgaaagccagcatcgtccagatgagcaacgcctggattctgaagaatctgccggaggccgtgtcgcgagacattgagctgtctattctgaatgtaggctactcgcgacatttgttgtatgtgccgttctacctccctcggccgcgcagcacgtcgaagcgcttgcgacgggtgatgaacatggacacgccgaccacgacctaccattcactcaccactacaaggacggcgaggtggctgatgcggtcaagcgcaaagccgagcggctaaaatcgcgtacctgacacgagatattcgaaatgagcgattttgattcgaagcgacgacagcgttttctgggcgaggactacttcaagtggctgctggcctccttttctgaaaacatcgcgagttgggaagaccggctgacccctatcggcgatactgaaaatgagaggaaggcgctgaccagaggcattgttgcctccgacagctatcgtcgctttctgctcatgtacacgggcggcgcggacatcagcctgctaagagacgaattcgattcggtggtctccgcattcgaacaactcacgatagccgagcgcgtacatcaggcagatgaccggcagccgccgctcgcgttcagtgaaatcggcgattatgagaccgcgatgcagctgattggcttttgctacctgctgcatcggcgtgacttgctgccgcgcatcgtcgcgatgttcgacccggcctaccgcgggaaggacacactctacgaagacctgctcgcgtatgaactcgaggggcgtgttgacgtcgacagctggtttcacgatgttccgtatcggccgctcgtcttcagcctttaccgcgaagcgaaacaggagtgtgtcgacgacatcacgcaatatctcgaagcctggtatccgggcatggcctcggcggtgtggcatgacggccacctcgaagcacagaagggcgacaaggggacgtacgttggctattgggcaatcgaagccgcagcggttgcctatctgctggagctggacgacagttccttccgggaccatctgctgtatccgaaggacctagccgactttgcgcgcaacttcgaccccgcgaaggggaatccgccggcacttcagaacaacgggcagaagacagtgcgtaccggtcaggtatgcccggagaccggtatctggaaagcacagggccaccatgtgcctggcgtgatggtgcaacagggcgagcgcatgccagaagtgttcgctccggacaggtcaggtgcataccgctcccaacctgcgctctgggagtttgaacgcaaggcctgacgcatagacgagttctccaagccacacgcacaaattttgatgcgcgcggtcttgccgaacttaacgcgttactttgcgatgaggaaacggtcgcgattctttgcgtcgcgaatccagagcggagcacgaccgcgcccagaccacgtctcgccagtcttcggacggagccccacacaccgaggctctgtgcgaagccggccgtaaccgaaactattggaaaaacgagggtaccgatattcaagacgtgcacgaaaacaccgaccggcttggtgtggccgggcaagccgaggaagtcattgattttccaacgaaatctgcgttaaaccagaactgatggcgatgtgcaactaaaactaatgcaactcagcatacgttaacttcagttacagacacccgattcaggtttggttacgagggtcttttgtgccgccgcgccaagccgttgtcgacacgcgagcgtgcttgccggcgctcgcttctaccgacgaaataaccgtccacggtctcatccggacgacggcaatgtgcctgctcaggcactgcccacttaatgtcgagcttcggaactcatatcacagcgggggcactcgagaggtcatcgcgtcgcgggtcttgaagcggaaagtgcgtttgcagcagtactgtgacttgctcgataccgtgcagtacaccggaccgataatcgccttgctggaaatgagcttccatggcctggcaaatcgcctcccattcgcggctgtccaccctggcgtgtatgccccggtcgacgacaatttcgacgtcccggtccgcaagaagcagatagatgagaatgccgttgttgtgctcggtgtcccagacccgcaggtccgagaaaacctcgatggcacggtccctcgcagagatgcctctcagcaaggctccgatgtgcagcgcccctctacagcaaacctgacttgaccgacatgcgcgcgatgacttgcacggacagcctcttcgatcgagattagcgtctgacgaggaaatgccttgtcgacccgccagtgggtcgcgaaagatgccggaacagacgtttcaggtccatgctcaccaccgtcccgatgcgccgccgccgccgaagcccccaccgcctccgcgaaagatgtcgcgattcgaatcacgaccgaaacgcccaccgctgcccccgatgaagcgcccgccagcggctctcgtaccgccacccagcagcgtgaagagcagcgccatcaagcccgccgcgatggcgacaagaagcgcctgcgacaaaatccatgcgagtacgccaacgacgccgcctgtcacgacggcgcctggcagtcggccaaacatggcgcgcagcagcccgcctgccatgaccgtcaggaggaagaggacgggaagcaaccgcccggcgccgtcgcctgacagagctcgccgctgcggcggagataacggttcgccgctggttacgcgcatgatggcgtcgaggccagccgtgatgccaccgtagaagtccccgtttcggaaacgcggaactatcgcctcgttgatgatgcgactgctcgtcgcatcggtgagcacgccttcgaggccgtatccgacctcgattcgaagcgctcggtcgttcttggcgacaatcagcagcacaccgtcgtcgatgttcttgcgccccagcttccattgctcgacgactcgcatcgaatactgttcgatggtttcgggctccgtggtcgaaacgacgagaacagaaatctgcgttccccgtttcgcctcgaactctctcgacatcgtctcgaggctgaccaactggtcaccggtcagcgttccagtcacatcggtgactctcgatgtgagcggcgggataacggcgtctgcgcgggcgcacgatcctcccaagactaagagggccaaggcgaaggccatcgccagtcggaacatgttcaattggaggccttgcccgcagatgccggcgtcgagccgaagtcgacccgaggcggtttcgaaatctcggcttcgttgctcaccgagaagttggggcgttccagatagccaaatgccttcgcagtcaaattttccgggaacgatcgtatcgtcgtgttgtacgcctggacggaccgaatgtatcggtttcgggctacggcaatgcgattttccgtaccctcgagctgcgcctgcaggtcccggaagttcgcgtccgacttcaattgcggatagttctccgataccacgagcagacgcgacagagacgacgtgagctgcccctgcgccgcttcaaactttgcaaacgcctgcgggtcggcaatgatttccggcgtggcgcgaatcgagccgacttgggcccgggcctccgtcacgcttacgagcacttccttttcctgattcgcataccccttcaccgtgctgacgagattgggaaccaggtcagcacgccgttgatattgatttagaacttccgaccaactggccttcacctgctcgtcttcgctctggatggcgttatagccacatcctgagagcgacagcacgctcagcgccaacgcgcccgtcagaagtgcacgggccagacggcgccgtgcggagattgcagctgagtttgtcaacatgcacgcgcctctgtccgatattccccggcattgcgccgctcaccggtgcactgcctatcgtaagtagccggacggtcgcagggttgacgcacgtcaacgctgcactgtcgagcgcgccgggaacgatgaaccacctcggtcgcgtgtcggctccaggggcttgctacgtatgaacaattcggcacgtggttcgttgagccacatcaagccatcgaaggggcgtcagcatagagtggtttcagggctcgaccggctctcgagaaccatgctcatggagaacaagatggcattcccgcgaaaactcgcaatcgcaattacggcgctcggcatggccagtgccattgcaatcgccggtacgccggtggccggcgacagtgcagctcacgacgcccatcatccgaataaggcggcagcaaaagcgccgggcaagtcaaaccgcgaggcggacgaccaaatgcaggccatgcgcgtcatgcacgaaaagatgatgaacgcgaagacgcctgaagagcgcgctgccctgatggacgagcaaatgaaagtcatgcaaaacggcatgggcatgatggaaatgatgggcgctcactcgtccggtatgccgatgtcgtcgcggcagggcagtatggaaatgcgcatggacatgatgcaaatgatgatgcaggcaatgatggaccgtcaggctgctcgggagcatccggcggagaagtgacgatacgaaacaggaggcagccatggatgacagcccgcatgctggtcggtcgttctggaaatcgcggtcggccatcgcgctcgcaggcttcgctgcaatcgcactcttcctgttactcacggaacatcgcgcccatttccttggcgtgttgccctatctgctgttgctctcgtgcccgctgatgcatctgtttatgcaccatgggcacgggcatcatgggacaaaatcgaccgatgggcgccccgattcgggagacagtcatgaccagcatcggtgacggttacgggctgtggagcctcgttgctatcaattctctcgtcttcatcatcttcgcgttcagcttcttcaagccggcaacaaagcgggactggagaacgttcggtggattctccgctttcatcgtcgcgctattcgcggagatgtacgggtttccgctcaccatctatttgctgtcgggttggttgcagacgcgctttccacaggccaatttgctgtcgcacgacgctggacacctctggtggaccctgaccggcagacacggcgacccgcatggcggacttccgcatctcctcagtttcttcctgatattgggcggcttctacttgttgtccaccgcatggcacgtactgtatgaagctcagcgtaacaacgagttggccaccaccgggccctactcgaagatccgacatccccagtacgtcggattcgtcgtcatcatgctgggcttcctgctccaatggcccacgctcgtgaccttggccatgtttcctgttctggttttcatgtacgttcgactagccagacaagaggagcgcgattcggaggcacggttcggcgctgcgtggcgtgaatacgcggcacacacgccgcgcttcgtgccgaacttgttcggaaaacacccggctcaagtacattgatttcagacggctccccgtagctggcgctgccgccgaactcaatcgcactcttccgggatgaggaggctggcatgaagcccttcaagactggcgtgacgctctcggccacggttgtgctcttctatgtcctatgcacgctcgtatggatggcacttcccgaaccgttcatgaacttcatgaacgcacttttcacggactcgatttccggcgtctccagacgggcgagccattgtcctggtggtttgtggtctacccggcctttgtgttcgcggtctggttctttgcagccggcgtcttcttcgcgtggttacacaaccgcttgagtgaacccaattgacgcaattccgtacgcctgcccatctccctgcaacggaaaagcatggaatgaacgttgctccgcgctatcgctcaacacatcgaagcgtcgtcgccggcgtgccccgatttgacaatagggactcaccgttcgcggcaccgtcgttacgccaatatcgaacgcgcggggcaacggcccccaatggaagtggaacgggtactcaaaggagcgtcaaatgagcggccagtccggcgaagacaagctgtatcacccacggatttccgagcacggggcgtcggacgaatctcacgctcgcgagacggacaagcatgcccattccaccgagcatgggcgcgacgcgcatactcatcaccatcaggttcaggaagaacacgttcattgcgcagattcacttcgcgacccggtctgtggaatgactgtgaccgatgcgtcacgcttccgctgcgaacaccatgccaagtggtacacgttctgcagcgaggcttgcctggcgaaattccaggctgcgccgtccaagtacgtcgagccctcgaccattgagcaaccgcaagcagttcccggggcaccctctacacttgcccgatgcacccggaaattcgccaggaccatcccgggcaatgtccgaagtgcggcatgacactggaaccgattctgcccagcgttgacgaaggcgaaaatcccgaattggtcgatttccgacgtcgattccggtggacgctgccactgaccatcgtagtgttcgtcctggcgatgttcggccatcgtttcgaattgatggatgttcgcggcgagagctgggtcgaattcattctgtcgacgccggtcgtcttgtgggcaggcctgccgtttttcgcgcgatgcgcgcgttcgttcatgaaccgcagccccaacatgtggaccctcatcgggctcggaacaggtgcggcgtatatctacagtgtcatcgccaccatcttccccggcgtgtttcctgaaacgtacagcacgcacggtcgagtcagcgtgtattttgaagctgcggcagtcatcatttcgctgacgctactcggacaattgctcgaacttaaggcccgctcgcaaacgtccgcagccatcaaggcgctgctcgggctcgcgcccaagacggcgcgccgcattaacccgaacggctccgaggaagacattccgttgtcccacgtgcatgtcggcgaccagcttcgggtgcggccaggcgagaaagtcccagtggatggtgtcgtgactgacggcacgagttcgttggacgagtccatgattacaggcgagcccattccggtcacgaagcgtgtcggcgaccacgtcattggcgcgacgatgaacgcaacgggcagtctggtcattcgctcggagaaggtcggctcgcagactgtgctctcgcaaatcgtgcagatggtcgcgcaggctcagcggtctcgcgcgcccatgcagcggatggcggataaggttgcgggagtattcgtcgtcggggtcgtcagcgtcgcgtttctgacattcctcctgtggggcatattcgggccggagcccagctgggtgtttggccttatcaacgctgtcgcagtgctcatcatcgcgtgtccatgcgcgttggggctcgcgacgccgatgtccatcatggtggcgagcggcaaaggtgctaccacggggttctctttcgggacgccgctgccatcgagaattttcgaaaggtcgatgtcctgattgtggacaagaccgggacgctgaccgaagggcgtcctgcgttcgagcgggctgtcggaacgaacggacactcggccgatgaagtgcttcacctggccgccagtctcgaccaaggcagcgaacatccgctcgcggctgcaatcgtcgccgcggcacgcgagaaagggggcagctggaccgagcggaaaaattcgaatccgtgacgggcatcggcgtgcgcgggctggtcgccggtcgacggctggcgttgggcaataccgcgctcatgcagactgaccaggtgtccgtcgagtcgctagcgaaggaagcagaccgtatgcgagcgcaaggtgcgagcgtcatgtacctgtcagtcgatggccgtttggccggtttgcttgcggtcgccgacccaatcaagaccaccacgccggaggcgcttgcgacgttgaaggagaacggcatccgagtcgttatggcgaccggcgatggggtggtaacggccaaggccgttgccgagagactcggtatcgacgaatatcacggagaggtcaagccggccgacaagctcgacttggtgacgaagctccagcaggcccggcatgttgtggcgatggctggcgacggcatcaacgacgccccggcgctcgcgaaagccgatgtcggcgttgccatgggaacaggcacggacgtggcgatgagcagcgcgcaagtgacgctcgtcaaaggcgacttgcgcggcatcgcacgagcgcgagagctgtccgaggcaactgtcgcgaacatgaagcaaaacctcggcttcgcgttcgtgtacaacgcgcttggggttccgttggcggccggggtactttacccgttcacaggattgctgctctcgccgatgatcgcggcgcttgcgatgagtttgagttccgcgtctgtcatctcgaacgcgctgaggttgcgtaacgccaaagtttgagcggcgataccgcatgcgagcctttcggactgtttcctcgatgaaaccttgccaccgctcgctttgtgaatctcgtacggactgaaggtagatgtcaggggtgttggaattaaacagcgtctccatggcctcgaccaggcgaatcgccagcagtctctccagagaatccgcggccggaccctaaagcaaacctcctctacacgacggtcgattccacgatggcgcagcaccatacgcgattgaagcaccaccggcccttgcaagcagtttctcatccggttctcccgcacctcgggaggcgcgccggtttgaacgacaccgaaccggaacagcaggtcgggtagcgctcgctacagcactgaacgctgccacttgtccttaaaattgacgaattcctttttctcaccctccactcgcccgcgtcgttcttcatggtgattcggaatatcgccaacatcccgacggtttgacgaatgatgaaaaccacctctccgtcggcggattccacgccatcttcaacgtcagtttcagggtcgtatgtcggcggatccgagcaacccaagtcaatcagacgaccttggtttgtcttatcccgcaatgtccatctctcgaaaatatccgaaagcgccttccgagcacaatcatctacttccgatacgtcgagcccactctccacggcactgcgcttctgcttataaaaacccttttcccaatgattcatttccaacatgaatgatctcaatgccgttcgcgcccgcacaaaatcatcatccatcatcttcaatctctcatgattgagaatatcgcccacaatcagccaaggagccggcagcaggcccgtcgatatcttaccgtcctgggtcagcgtgcctttgagttggtcgcatgcatgtggagtgggacgcgcgcaacgagcagcaggcggctcgacttcgctccgcacaagtctctcggaaatgttcaatgaattggcactggccgcgcggcgatcaaagggcggccgtgggaaaaataccggtgacgtccaatgtgcacgcgacgcagagcgctttcacttggcaccaacatcagccgaacggcgacaacgaccatgcatcgcgtgacggccaccctccggtcaattcccggaggcagccgaaccagcccgaacgaaatgatgctccatcctcgtgcgcagcacgccatcgagcgcggcaagtcgatcgcgcagtcgaaccgcttgcccttccgtcatttccccgagaacgatcttctgctcgagaacgtcgccacagcgggcgatggcccaccggtcgaccgtggcggtttcgccttcgagtacggcagccgctgtcgacacgatgcccggattcaatcccgaaacgagatgaaccgtatgcgtgagcgtgaaaccgggaaggaggtgcgaccagtcttctgagacggtccggcgggaagcagcggtatcctggcgcatgattgctccggttgagtggttatcgaaccggtgccagccatgctgctcccgtttcgttgccgtaaatcggccgcatcgcctcaagggcgtccaccttgcccgggagggcaggttggcgtcggatgacccgactctggatgcttgatttctctcgttcgacattccgaacgatggttcattatatcgaaaagcacgcgcagcgcaagaagtgtcgggagagcggcactttagccggatgacctcaccgatccagcccttgtaagcgacgcgacaggaagagctgtgtcagtcctcctcaccgccctccaaccaccccgaaacctacgccctcacgcgatatacctgttcttgatccggatatcccgcccctggaacggccccgtatcgtgctcatgcagatgcacgaccacctgcttcggatcgaacagcctcgacacctcgcggaaatcctgattcacgcgcttcatgccttcgaccatctcgccgtgcagcgccgcatcgtcgagcggcatcggcgcactgcccaacgcccgttcgagatggaggtgcaggaaactcgtcaactgcgcatcctcggtcgtcgcgagctggaacgtgctgatcgcgtcatgaagcaccggcgaagcggacagaacctgctcgatgtcggacgggaacactttcgcgccatagaacggcacgctcgaatcgttgcggccgtacacgaacaggaacgggaaatggctggtccgcgcggcaaaatcctgcaggcgcatgccatgtgccgacagacgcctgttcagctcacggaatcgatacgtcccacccgaatcgcgaatgttgtaccggatcttcggcgccgcgcccgactgccgcccgatggtcaccagcagctcgccatcgtcattcgtttcgatcacgtaatcgagcgcgttgtactggaagatcatcggcggcgtatcgcggccgaacagctcgcggcacagctcgggccgcgtgagcaacgcacgccgcaggccgatcgtcgtcggcgtctcgacgccgatgttgatctcgaggtccgacgcgccatacgacgagatcaccgtgctcgccttgcgcagcagatggtcgcgcaacgcttccgacaacccttccccgccgacgatgaaatcgatgtggtacgcgctcaggtcgagatcgcattcgtcgaccaccgagcggatgaacggcgggtagccgaatatcaggtactggtatttcggtccgaacagcttcagcgtgttgatcagcttggccttgtcggggccgatcgacttcatgatgccgacgtcgacgagcgacatcgacacgttcatgccggtcgcccacggcccgagcgcaaagcagttcagcagcatcttgccggagtcgcggaacaccagcgatagttcagttgcaggatgcgcttgacgtcgctgcgttcggccgcgctgcgcacccagttgttcggctgccccgtcgaccccgacgattcgtcgatgacgacacccgacttcggaatggcgccaccgtagcagcgctgctcgatcgaatagcgcttgatgtaattctccttggtcatggcgggcaggtccgccagccgccattgccgccggccttgtagccttcggccttcaggaactcgatgtaggccgggcacgacgtgctcgccttgaggaacgcgacgcgggcgcgcatgcggccgacataagccagatacggctgaaaaatcggcgcgttgaggaacacatagagacgtccgtcgacgctgatcacgcggcgaaggaaccagagcgtccagagaacggcttcgagaaagaggcgaatgagcgtgttcatgcggattgcggcgaatgggatggaaccggcgcgtcgacgaggatgtcggcaagcgccctgcgctggctttgcggcggcgtacgcgagtagccgaccttgaacacgagccatgcgcggtcgaccccggcatgcgtgctgaaccacgcggcggcgtcggggttcgtgaccaggttgccgtacggatgcaggtacaggccgaggctcgtcagcgccagccagaagcgcagcaggaaacggcccgactcgatcgccttctccggcttgaagaaatcgccgctcaacacgccgatcgccggcacatggccgagctgcgaccggtaccggcgcttgaaatagaagcgcgtcggcttgaacgtcaggatcttcgacagacgcgcggacatccagaactcggcgcgcgacaggttcatgcagcgccagtcgagaccgtcgcgatgtcgggcagtcgaacgttccgtgaaccggaaccaggccgtgatctcgtcgtggtagtccgcgacgttcatgtcatgaaacacggcgtcgatgttcgccgcgatgatcggctcgatcagttccgcacccgacagatgcgtatatcggtgcccccattcgtcggccagcgccgccagttgcgtgacggcggcatccggcaccggtgtcgggtccatcgaaatgcgcgacgtgcggcgcgccagcatcagcgcggacggatcgtcgcgcgacgcatccgcattggtgttggcgacgagccgcaacgcagcgaacggaatcagtcccggcggcgtcggccgggacaggatggccgcgaattcctgcaccgggcgatgcagttgccattcgacgcgcaagccatgcggtgccgcgagcagatcgatcgcgtcgatgaacatgcccgtcgcggacaacaggaacgcgccggtcgtgtcttctttcggcagcgtgcgcgtgccgtcgatgaacagctcggcgcaatcgtccgagatcagttgcacccgccacggctgaacgttgtgcggcgacggtgcgtatcgggccacggacaggatcgtgtgccagacagtaaaggtttcagcgggaatccccggcatttctcgtggcttccttgttgttgtgcggctgattgccgttgtggcgcgagaaccggcccctctcaagaccgggtgaagctgtgcgcatcttacatgagggccgaggcagcctcacggatgcccggacggcagatcggctgcgacgcaaccgtccgcgccccgaagcatcgtccgccgtcacatgcggagcctcgtggccggtcgaagccccgctcgagaaccccgctacttcgacaagtgcagcttcttcgacacgacgatgccgctcgactcactcaccagcgagatgtcatggatatccatgtgtagcgtggagatcctcgtcgtgatgtcggtcggctcgtcgatactcggatcgacatgctcggtttgttccgtcaggtaaggccgaaccagccgcccggagaaaacgagtgcgaattcgccgctcgctcgtgcgtgctcggcgggcgatagccgcatgcggctacgaatcgccgtcttttgccttggccggaatcgagttcgatgatgtcgacgtgctggatgtaccctttcgccttcgcttcgggtgcaatcacgagcccgcgccctcgcggccccgtcgtgacttttctgaggaggatgcccgtccggtcgttgcgctctgcgtcgaacaggtcgacgtccagcgtcaacaggtgccggcgtgacgagtacctcagcccgtaccgcaccggtaccacgaacgtcacgtcacgatccagatcgacggacgccaggtcgggattcgggccacgccggtcgaccgcgctggagaccaggccgcgaacccggtcgcgcaacgaaggtgagagggtagtgatgtgcagctttttcagcgcatcccggattgcaaccgggtcgtcgccggcaatcggtcgtgccggcgacgtgtcgggatggacagccgacgcgacgcgcgccgtgccgtccgcggcctccgccgctgcatgcgccgcgaccggcgccagcatcatcgccagggcgacgatgcacgcgtagttcgagcgacccaatgtggatttccggtaaaacacgacgaactcctgattttcaacgacgtgcactatagggtggaatgatcggcaacgcacccgccgtttgatattcacggacggccggcgcgcccatcataggttcgtcgtcggcacggcggcaggtcaacggacacactaccgtgttgcccgggcgacaacaaccggagggaaacgcgcagcgcccccgcgtcaggaatccgcacactcatccccgcccgtcctcgcgccgatactccgccggcgccttccccaccagcttccggaagtcgcgcgtgaagtgcgcctgatcgaaataccccaacgcctgggccagctccgcgagatcgaccgcctcgccgcccgcgagcttgtccgcggcttcgtgcaggcgataacgacagatcacccatttgggcgtcacgccgacatggctggaaaagagctgctgcaacgtgcgttcgctcaaccccgcacgctcggccaggtcgcgcacctgggtgagcccgatgtcctgctgcagcatctgcaagatggcatgaatacgctcgacctgcggatcgggcggcggcagcacccgcaacagcagcgcctcggccgccgccaccatcccggcatcgtccccggcgccgagcacggccgcttcggcttccgcatcgccgcagtcgaacagcgtcgacaccggcagcaccttgtcggtcgtcagatgcaccggtttgccgaaaaacgcccggaacgcgcccggccggaaccgcaagccgatcaccctgccggtgcccgcgagcgtcgtctcgaacgcccccgacaccacaccgaagatccccgtctgccgcctgtcgaacaccacattcacgcacggatacggcagtgtgcgctgcacgtaaggcggctggccgcgcagatcccattcgacgatccagtggtgatccagcacgccggccagttcggctcgcgggtgataacgattgagacggaagcgctgattgatcgccttcgggccgaccacgcccttgggcgtgtcggtcacgttacgcaggtcggccatggtcgggaaccggtgaggtgaaggcgcaatgatgcaccgccacagcgggtttttccaagacgagggtgcgcaaccgtcctacattcgaatccctgccgacgaacgcacccaccggagcccgccatgccgcaagaccgtcacctgaccctgttccactctccgcgcagccgctcggccggcgtgcggatgctgctcgaggaactgagcgccgaccatgaactgcacgcgttcgatctttccaccggaaaacaccgcgacgccgaatacctgcgcatcaatccgctaggcaaggttcccgcgctgcgtcacggcgacgtgatcgtcaccgagcaggcggccgtctacatgtatgcggcggaactgtatccggaagccggcctgtcgccggcgccgggcgattcgctgcgcggccctatctgcgctggatgacgttctatggttcgtgcttcgagccggccctcgtcgaccgatcgatgaatcgcccgcccgcggcctactcgacgtcgccctatggcgacttcgataccgtcgtcgacacgatcgatgcgcaactggcgaagggaccttacctgctgggcgagcgctttaccgcggtcgacgtgctgtggggctcggcgctgaactggaccacgatgttcaagctggtgcccgagacgccgcgcattcgcgcctacatcgatcgcgtgcttgcgcgcccggccatccagcgcgcgcaggcggcagatgccgcgctggcggcggaacaggacaaggccaaagaggcggccgccgcagcggagtagtccattggcgggccgaccttggccccggatccgcccgccgccccgtcaaaacaccgcatgcatccccacccgcgccaccgtctggttcgccgaacctgaagccccgttcggatccagcacgccattgacctgcgcattcgcgccgctgttcgcgcgttggtagtcggccgacacataaaccatcgtccgcttcgaaaacaggtactgaagcgccacactgacctgatgcgcgtggttgtcgttcaccgcttcgttgcccttcatgtacatgtatttcgcgcccagcacgacatccggcctgatgtgccacagcccgccggtctccgccatccacacgccggcatcgttgagcgcgttgtgcacggtggtcaccagcgcactcgcggtcacggcaccgaagtcgtaatgcatcccgacaccccagttgcgcacgctggtggacggcacgccgggcgcgggaccgtacttctcgttcgtgtaggccgcaccgaccccgaacgcccccatctcgtagttcacccccgcgctgaccgcattgtccgcgccgaccgagccggccaccccgccgaacgcgtacatcacgccgccggaaaaacccgcgaccgtcggcgaactgtacttgacggaattcgcgatcggcttgctgcctgccgtgcgatcccaatcgaacgcaccggtcggattgcccggcagcgcgagacgctggaacgggccattgcgaaagccgtacagccccgagatatcccgagcgatcgcattgcccttcgaaaagagcgaatccaccatgaagtcgtactggttgcccagcgtgatgcggccgaaccggttgctttcgaggcccacatacgcgttgcggccgaaaatccccgtcccgacgatgctgccgttcgccatcgagaactggttcacgagcgcgaacgtcgcgcgatacccgccaccgaggtcttcagtcccgcgaaagccgaagagattgggcgcgaatatgccgtcgtcgaacttgacgttctttccgccgccctcgttgctgacataagaaatgcctgcatcgatcagaccgaacatcgtcacgctgctctgtgcccatgcgccgtgcgccacggcaagcatcaccactgctccaaacctgagtttcatgtcgtctccgtctttttatgaaaatgcgaggccgccacccgctacgtggcgggtgctcgctcggtgcttcaaaggaaattgcgttcattcaggcggaatcgaacaacgcatgaaccatggttagctcgactgattgatcaattcgatgaccatcgcatcgacccgccccgctcgtactcgtcgaagcgcccgaatcaagcgccccgatggacgatccacgcggtggaatccacctcgaccgtcacggcctccagcgccgaacccgagcaaggcccgtcgatacacacgccatcgtcgaaccggaacagcgcgctgtgatgggcgcacatcaacacctgcgaccggtaacaggaaacgctgcccgggacgaaatcgagcggcaccgagaagtgcgggcagcgattcacgtacgcccacacctgcccgccgcgtctcacgacgatcacgggacgtccgatgcaggcctcgtcgacgacccgcgcgccgccgtcgggcacatcggaaaaacggcagagttgtcgggcttccatgtctcacaccctctgctcgggattgccgaggctccagtcccacggccgcacttcgacgtgcgaaaacagcccttccttcacgtacggatcgttgccgacgaactgcatcaccgcgtgaatgtcgtccgcctccacgacgagcagcgtgccgttcatcgcgtcgccgtgcggatccagcgtcggcccgccgagccgcacgaccacgccgtgctggtcggccgagcgcaggtaggttcgatgaatcggccgcatgcggtcgcgcacgtcgcgcatgcccggctggtccgtcgcaaacaccgcaaaaatcgcgccatgtcgatcaactccggtcgaggacgagtgcgcgaagaggccgtacgaggcaccgtacgcgcaggcgcgtgcctggcgtgccgtcgaagccggcggcaacctgcccgatcaacccggcatcgccgtcatggtggtcatcgctcatgtctgtctccgttgacgcacgagccgctcaccgcggcgcgcgtccttcccatgcgtgctgaagcagcgcgcgaatcgccgcgcgttcgatcggccgcgggttcgcatacggattgcgacaggcgaggtcggccgcttcgtcgagaccgctctccggcatcccgaggtcgacgagcgccggtgcgatgccgagccgcgcattcagcgcgaacagcagcgggccggcttcggctgcgtcgtttccgcccaatgcgcgcgccacgcggcgcagcgcatcgggcgcggcggcatggttgtagtgcgcggtatgcggcagcatcgccgcgtgcgtctgcgcgtgcggcaggttgaaggtgccgccgagcgtgtggcacagcttgtggtgcagcgccatgccgaccgcgcccaggcaggttccggcgagccacgcgccgtacaacgcacggctgcgcatcgcgcggtgttccggatcgcgcacgatcacgggcagcgcgtcaccgagcgcgcggatcgactcttccgccatcaggctgatcaccgggttcgcgtcttccgcatagagcgcctcgacagcgtgcgccatcgcattgatgcccgatgccgcggaaatgtccggcggcagcgtcaccgtcagcgacgggtcgtagagcaccgtacgcggcagcacgcgcgcgtcgcgcccggtgcgcttcagccggccttccgtgagcccgaagatcggcgtcatttccgaaccggcgtatgtcgtcggcacggccaggatcggcaacaccgactcgagcgcaatggccttgccgagcccgatcgtcgagccgccgccgatcgcgacgcagcagtccgcgtccagctcgccggccatctcgcgggcggcatgcgcgacctcgaccggcacgtgcatgaccgcctgcgcacagatgccggccgcacgctcgcccaggatcgcctccacgcgctcggcgagcggccgctgctcgggcgtggacaagacaagcgcgcggcgggcgccgagcgtcgacagctcgtccggcagcctcgcgagtgcaccccattcgaacaccacgcgggaaggcgtgccctgatagacgaagcgatccatggaaaacctcagcgcttgaagtgcggcggcacgttgccgtcgacgttgacccacaccgatcgcgcttccgtgtagtcgtgcatggcctcgaagcccatctcgcggccataacccgacttgccgacgccgccgaacgggctgcccgggttgacgcgcttgtagcagttgatccagcacatgcctgcgttgatccgcgatgccatccggtgcgcgcgcgagaggtccttcgtccagaggccgctgcccagcccgtattccgtcgcgttggcgatggccagcgcttcgtcgtcgctgccgaagcgcagcaccgtgacgaacgggccgaacacttcctcctgcgcgacgcgatcggccgcgctcctcgcttcgatgaccgtcgggcgcacgtagtagccgccggcgagcgccgggtcctgcggcgcgctgccgcccgtgagcacgcggccgccctgctcgcgcgcgacgtcgacgtacgacagcacgcgatcgaggtgctgcttcgaggtcagcggccccatctcggtatcggcgtcgagcgggttgccgatgcggatcgacgacgcgagcgcgacgaatcgctcgaggaattcatccgcgatgcgttcgtgcagcacgagacgcgaaccggcgatgcacgcctgcccctggttgtggaagatcgcccatgcggcgccgttgatggccgcgtcgagatcggcatcgtcgaagacgaggttggcgcccttgccgcccagttcgagctgcacgcgcttcaggttgccctgcgacgcttcgacgatccggcggccggtggccgtcgaccccgtgaacgcgatcttgccgaccccggatgttcggcgagccgctggccggccgtatgcccgtagcccgggacgatattgacgacaccggcgggaaacccgacctcggccatcagctcgacgatgcgcaacgtcgacagcggcgtgatctccgacggcttgagcacgacggtgttgccggcggcgagtgccgggcccatcttccagctcgtgaacatcagcggaaaattccacggcacgatctggccgaccacgccgatcggcgcgcgctgcacgtagttcaggaagccggtttcgaccggaatcaccgagccttgcagcttgtcggccatgccgccgaagtagcggaagcaggcggccgtgcgcggcacgtcgagcgcacgtgaatcgcggatcgggtggccggtgtccagcgattcgagccgcgccagttcgtcggcgttggcctcgattgcgtcggcgaggcgcagcagcaaccggccgcgttcggcggccggcagggccgaccatttgggaaacgcgcgcgcggcggcttcgacggcgagatcgacatccgccgcgtcggctgccgcgatcttcgtgatgacggagccgtcgtgcgggttcagcacgtcgatcgtgccgcggtcgacggcgtcaacgaaacgcccgtcgatgaagagttgggtttgcatgaatcgtcctcggtacagggctgaagcggaagcggctgcgttgctcagaacgcgatcggatacggcgcgagctcgccgctctcgtagcgttgcggcaggtccggcgtcgcgttttcccagacgagcagcatcgaccgcttcgtcgaataaccctgatgccggatgtcggcgggcatcgcgcagatgtcgccggcgcgcatcgtgacgcgtgcgcgcggtgcgccggtgttcttgtcgccgatgtcccacacgatttcgtcggacagttgcaggaaccattcgacgcggtcgttgccatggaacaccggcaggatgaattcctcggtggtcgggcagaacaggctgcgcccgcagaccgacgtgaccgacggattccacgtgacgtccgaacgcgacaggtacttgaacaggttgaacgcgtgcagttcgccttcgaagcccggctcgacatgcacttccggttcgtcctgcgcgacgtcgaggaacgcgcggttgaccggcaggtcgtcgcgcagcggcgagtcgccctcgaggcccggcatgcggcgcgtcgcgatgcgcgtgcgctcgatcgccgcgccgttgtcgccgtgcttgcgcccgaacgccgtgcccgtttcctcgggcgccgcgaacggatcgaagccttcgttcgtccagtcgtgcagcatcgccttgaaggtcgccatgatcgtgggcgtttcgaaggtctcggtgtagtcgacgccggcatccttcaggatgccgttgaacgtgcccgcatacacgtccaccttgccgtagtgattgcgcgtgccgaacacgtggtcgaaattcacccagccgtagaagaagccccacgccacgtcgcgcatcatcgcgcgcaggaacgcgtccgccggcatcgcatgcgtgcgggtccggcctttcgcgggccagctgatcttcacgaagtattcgtcgcgctggaacgcgaattcgccgagctggaagcggcggtagccggtgacggcatcggcttcggtcgatcgcaccagatcggcggcaaagcccgtggaaaggtcgagggtgtcgagggtggccataacgtgtctcctgggaatgtcgaatgaagtcggacgaatcagtgcaggcagatttcggcccacttctccacggacagctcgccaaggacggtctgcaccagcgcgacgcccggccggctcgcggtgaagcggtatgcacaaccggccggcagcagcgcctgatggcccttgcgcagcacgacataccccatcttgcggccggccggctgggcgccggcgctcacggtgccgcgccccggtttcggcggcgaatcgagcttgatgaagtcgatccggacctcgccgtccatctggatcacgaactcgtcgtgcgggcacgcaaaccacggcgactggccgtcggtccgcagcacttcgatcacgtattcgaggttcttgccggcgacgaccttttcatacggagccgatttcgatgcgacctcgaacacgttcgagaacgcgtagtggcgggcgctgccgctggtgatttcgatctctccttccggtaatggtcgagcgagccaaagacggtgtggaatgccgtgtcggtcattgctgtctcctgagttgaactgcttgttggattcaactctaggggcaacgcacagcagcaacaaggcaacggacggcgattacggcatttgcgtttcgcgaataatccgcgcggttcaacgcacccagccgcgctccaggagggacgatcccacggggattcgtcgccgatatggtctgccaggaattcgaccagcgccttcaccttcagcgcctgtcgctgcgtcgcgggataaacggcggcaaagctcagcggcgcgagctgatagtcggtcaggatcggtaccaggcggcccgcgacgagcgcatcgctcgccacgagcgtgggcaggcagacgacgccgccgccggtcagcgcgtactcgcgcagcaggtgcacggagttcgagcggatcatgcccggcagctccatttcgacgacctcgtcgccgcgcgtcatcgtccagcggttgcgcgacgggtagccggaatacagcgcggtcgtgtgctgcagcaggtcgcgcggatgttgtggcgcaccatgcgcggcgaggtaggcgggcgacgcgcaaaagaggcgcctgacggtgaacagccgccgttcgatcagcgactcggagatcggcggaaagatctggaacgcgatgtcgaacccttcttcgacggggtccaccacacggtcgttgacgatgacgtcgatctggatgcccgggtagcgccggttgaattccatcagcggcgcgccgaagtgatcgagggcgaaaccgggcagcatctggatgcgcagccgcccggtgggcgtggcgcgcagctcgcgcatctggtccgtcagctcgttgacgcgccccacgacctccgcgcactcgcgataaaacgcctcgcccacttccgacaggcgcacgtggcgggtgctgcgatggaacagcggcgcgttgacgaacttctcgagctgctggatgcggttcgtcacgaccgagctggtcacgccgagctgccgcgccgcctcggcgaagctgctcgcctccgccaccctgacgaatgcctcgatgctcagaaaccggtccatgccgcgccctttttcgacagcgaaaccggcagtctacccgtgcggatatcgggctgtgtcatgcgggaggcgtcactgtgtcacccaatcgatgtcaatcgccggcagcgccgcccgccgcatgcaccgccctgccctgccctgcccgcacgggccttaccgcgattgctcgccggccgccagttccggctgcacggctacgcggcgctgcagcacggccggcgcggtttccttcagcagcaggctgaccacgatgcccagcacgaccgcacacatcggcagccacagaatgttctggatgccaaagtgttcggcgacgtagccgcccagcgccggcgcgatgccgccgccgaagatctcgccgacgcccaccaccacgccgatcgacgtcgacacgagcccgacgggcgcggcctccgtcgccaccggcccggacaacagcgacaccaggccgagcgtgaagaacgacgcgacgaacagcaccccgaacaacgcgaacggctgcgggccgaggccgcggaacagatagagcatcacggccgtccccgcgaaaccgacgatgctcgcgagacggcggccgaccaggtcggacaggcccggcagcccgaactgcccgagaaagccgccgaagccgatcgccgacacgacgaggcccatcttctgcgtgccgagcgccaggtagtcggtcaggtaaagcggcagcagcgcaccgagcacgaatacgcccgtcatcgcgcagcacagtgcggccatcgccacgaggatgttgctgctcctgagcacatggccgagtgatgccggtgcatgctccgacgcgacggccggcgtgaccttcggctcgcggatgacgaagaacatgatcgcgccgaggatcaggccgggaacggccacgagcgcaaacacccagcgccacgacacgaaaccgagcagctgcgtcgcgatgatcggcgacagcgcgagcccgaacagcgcgaagccgctttgctgcaggccgaggttcagcccgcgccgccgcggatgcgacgcgtcggcagtcgcggcaaagctcgtcggacagaacgagccctccgcgacacccatcaggccgcgaatcgccatcagcccgagcagcccgcccgcgagccccgagaagcccgacagcagcgagaacgcgatgatggccggaatcagcaccttcctgcgaccgaccttgtcggagatgccgcccatcagcgccgcgaagatgccccacgacaggccgagcacgccgatgcagttgccgacgtcctgcgcgttcaggttgaggtccttcatgatcgaaggaaacagcggcgcgatcagccagcggtcgaggccgaccagcccgaagccgagcgccagcagcgtgaccgccttccactcataggaggtatcccactcgtttgctttcatttccgtctccgtggacacagcttcgcctgcgcgcgacggagcgcctgcgcatcagccaggtccgatggtttttgtgtgcgatgtgaatcgccgggaagcgccggctgccgttccggttcgacgtatcgaatccggcgagccgacggcacaacgataggtgcaacgccagggatcgagtatcgaacgaccggcgaacacgccattcgcgatatgcaaataatcggcggcggcgggcgggaagtgtcggtgggacggcggagagagaacggtcgtggggttgaagtgacgcgcgattgcgcgtctcggggaaatcctcatggacatccgggcgaccggggactggcccgttcacgcccggcatgcacccgatccggcgaggccgggcgatacgtgcggacaacgtatttcgtatgacaaaagatgcgttttcgatcttcgaacgcggtggacttggactcgcgttccggaatcttcgcgcttacgcagttggccatggcgagccgtgacggaaacggccttccacactatcaaactgaaaacggcaaaactgctgtcaagcggacacgcataccggatgcacgagcgcgatcctactcacatcgatttttatatttcaaatccgccttacccatattcgaattaggacaagtcgaatttcgaattaccaacatccaatccggttcggcatagttgcccgcaacctccacctcctaaccgcccagaaatggatagtgacaaataccaaccctgacggcccgatataggatttttccaattaaaacaaaacgccccgccaaattataaaaatgtagaacaccgtttcatagtgaattgacttccatctcaaaataccaataaacctttaaaaccccattgtttgatattctgcgcaccgaaatcacgatcaccactgctttaccgcactgaaagtccgactcaaagaatacgaagccagaaaagcaacgagattgccgttatgtcgatagcaacagcattacgaaactttgcgtccggtctggtcgactggaacacccggcccgtcgccctgcacttcgggcaggcgcaacacgcggtcggccatctgctggcgcttcatcacgccgatattcgcgaaggactgatgtcgggaatcgacgggcagctgacctgcatatccacccacgctcatctggcgcccacgctgtttctcggcctgccggtgtcggtccggctgacgaccgaccggggcgacgtgcgggcgatcaatgcgatcgtgcacgacgtgcaggccggtcaatccgacggcgagttgaccgtgtatcagctgcgcatctgcgatgcgctgtcgttgatggaccgccgcatcaattcccgagtattccggtcgcggaacatcatcgacatcctcggcacgctgctgaacgaatggcggcaacgcagccccgcactcgcgcgcgcgttcgatttcgacctgtcgggattgcgagccgaacgttatccggcacgcgaactgacgcggcaggtcaatgagtcggacgctcgtttcgtgcgccggctgttgcgacgcgaaggcatcaccgtctttgcaaaggcgcgggcggtcggcaatgcgcgcggcacggccgacgagcggccgatccacacgctcgtgttctgcgacgacccgctgcgattgccggaatcgcctgccggcaccgtacgccttcatccgcgcgattcgggaaccgcgcaacgcgatacggtgacgttgtttgcgcatcatcagcgcctgtccccggcaaagccggccgtccgtcgtgggactacaagaaggcgcgcatggacgattccgcgatcgcgacgagcatcgatcagggcgacgccggcaacgacctggcccggctgctgaccgatgtcgcgatcgacattccgcacgtcggcgactcgtggaacgatcacgaccgcatcacgcatgaccggatactcgcccaccagttcgcggcggagcgctacgacggtatcggccacgttcgcgacatgccggtcggctgctggttcacgctgaccggcgaccccgaactcgacatgaagccggccgagcagcggcagttcgtcgtgacgtcggtacagcacgacatccggaacaaccttcccaaagacctggccggccgcgtgatcgcgctgtacgcagccagccggaacctcgcgcaagccgccccacccgcgccggccgatgcgtcggaacaggcagatacgcgctacgagaaccatttcacgtgcgtgcgtcgcggcgtgccgctcacgccgtcctacgatccgacaatcgacctcccgccggctcacctgctgaccggcacgatcgtcggcactgagggcgaggaagtattctgcgacgcggccggccgcgtgcgcgtacggattcatggcttcgatcccgccgatcacgaacacgcgcaaggcgccggaacgaacggggcggccggcgacagcgcaccgatacgcgtcggcgcgagtctggcgggcgcaaacttcggcacgctctttctgccccgcgtcgggatggaagtcttgctgggctgcctgtcgggcgatccggaccgcctggtcatcatcggcgtgctgagcaacggcgcgaacccgcccgcgacgttcacgcataccggtgcgctgcccggcaaccgttacgtgtccgggatcaagacgaaggaaatcaagggcgctcggtacaaccagcttcgcctggacgatacgccgtcgcagatatccgcgcagttggcgagcgagcatgcgcatacccagttgaacctgggttatctgacgcagccccgcaaggatggacacggtgccgatcggggcgaaggcgcggagttgcgcaccgatgccgcggcggccttgcgcgcggcccagggcatcctgttctcgacctatgcgcgcacatgcgcgaccggtggtcagctcgatcgtgacgaactgattcagttgctcgaccagtgcatgatgctgttcaactcgctcggcgactatgccggccagcacggcggacgagccgcggataccgccgggcaggagaagatcgtcgatgcgttccgtcactggaagcccgatcttgcggatgccggttccgccggcgacacgtccgccttgatggcgttcggcgcacaggcaggatcgctgcacgtcacgcccagaacgcatgtcatgtatgcgggcgagaacatcgaccagattgcccagcggcacgtgcaggtcgcgagcggcgagcgcatcaacctgcacggcggccatggcgtcgcgatgttcgcgcacagcggcggcgtgtcggccatcgcgaatcgcgggaaggtgacgatccagtcgcaggacgacgacacgcaggtggattccgcgaagaacatccagttgaccgcggccggcggcaagctcgccggcatggcgaacgatcaggtcgtgttcgtcacgtcgggcggtgcgtacctgaagctgaacggcagcgacatcgaactcgggtgccccggcacgttcaccgtgaagtcggcaggccatgcgtggggcggcccggccagcatgagcaccgacatgccgacgttcgaccacgccccgctcggccgtgtgccgaaactcgttcgcgcgaccgacggcgatgcggtggcggggttcgacgggcacatgcagcgggcatccgaagcgctgtcgaacctgaccaccgacgcggccggcgaactgcccgcagtgcatggcgaccagttcgaaacgctgtcggtgcagttcatcaagaagaatggctaagaccatgaccgattcgattctcgaccatcggccagtagcgggcgcgcgcgccgacgcgcccgacacgacgaccgacgcacccgccaccgctgcatcgcactccgaattgcctcctgtcgtcgtcggcagagccgaggggccgatgctgttcgacaacgacaagcggctcatctgcgtcaagcaactgccgttgcccggcgtcgtcatcttcgtccacggcgtcaactccgagggcgaatggtacaaagcgtcagaagagggattgtgcaagggcctgaatcgtcggctgggacgcctggacgaccagatgacgtatcacggggtcgacgccgggcagttgacgcctgcgaagtacaccgagagcgtgacgccggaggggtttctgaatccggacttgctgccggacaattacgtcatccccgatccgtcgttctcacccgtcatccattttcggtggggctaccgcgcgacactggaagaactgaaggaatacggcgacaagatctttctcaacgagaaggattattgggaggcggcccgttcaccaatggctgttcgagcttgcccgatctctggcacggcggtctcgacgaccgagccgtggggtggataaccgtgcagggcatcaacccgaccaaccggccgctgtatcgcgcgccgccgcgtgcctatggcgtgcttgccgcgttgcggcttgccaaactgatcgagtcgatccggaagatgcgcgccgacgtgccgatcaccgttgtgtgtcacagccagggaatatcgtcggcctcacgggcgcgttcttcggtgacgcgttaccggaagtggaagatccgtgggggcgcaagggacgctgcgtcgcggatgcctatgtgctggcgaatgctccatatagcctcgcgaacagtgaaggcccgcacaaatccgacacgttcatggatacctggtcgcaacgtgcgacgaaggatgccgagggcaagcgcggccgacagacctacgcagcgcgcactcagacgctccgcacattcttgtcgatgattggcgatcgcgctgcccatgaaccgtcgccagacacggtcgatgccgacatggcgaacaaccgggtatcgccgacgagcaacaagtcgataccgcactggccgaccgtgcgcgccacggcctgaacggatcgacgtatgggcgcgtcaccgcgtattgctgtccgcacgatcaggtgatttcggcgatcaccgtgcagggtatcggctagcgcggcatcgacaggcacgaactgacggatatcggcgtacacggcgtcctgacacagcgcgtgttcgcgtccggcttcgatgtcggtgtgcagaagcgctatcgctattgggaagacgactggcggtacggcaagaaaggcacgaagaggggcttctggtatccgccctcgccgccggcgaaattcaatctgatcggtgcgctcaaggggaatgagtcggtgtggggaatggcggcaacgctgttctcggcgccgatcatgttcgtcgcgaccgcggtcagttcggcaatgaacatgtttcgtgtgaatgccgatccgccgaagggttgggaggtattggcggacgcaccggccctggacgagacgtttccgccgcaggcgttgaggttcgacaagccgattctgaccgaggacggcgaagcaacgagcgccttcaacgaagacaacgatccgccatccgcatggcgcgatgccggcaagatcgatgcggccaaacgggccgacgatccttacgaccagtacaaggcgaagaacaaggacggtgacgcgcacggtacggccgcgagtgaagccgggcaacgttacgaagaccgcgccctgatgcggatggaagcgcgccgcacgttgaacacggagtggctcgacagcgacggtcacgtcatcggtgaagatggcaaaagcgctctaccggatggctacaaagagtggcgagacaagcagatcgttgactggctcgatcgcggtacgacgaatagcccgacgaaccactcgacgacgatgaccaatccggaacatgcggaaaaagcgcttgcgtatgacgtcgcgatcggtccgtgttatctgacgcctgatcagatgtacgacttgcgaattgaagcagattggcggatgggtgatggcattccagacggccatccaaataaaaagtacacgcagtatttcatgctcggcgtgattgatgacgtgtcgatgcaagagtgggtacatgccgacaacagtgaaggaaagataccgacaaagatcgtagacgagcgcgagggccagatctatctgaacgccggagggccgctatgaaggccgtgatcggtacttggcctcgacgcgtcgccatcgccgttatggtttggatagtcgcggctctattgatggccacactgatggcacatgtggaacaaccagacccggcacacttgggaataggagattggatgaaacgattcgtagttgtgcccggcttgctggcgctcatgatctttctgttcaccacagccttgacgcggccggtgctagccgagacgcccctcaatccaaccattcgcgcagcttcccatacggaagaaccggccaagcccctcgtagcacaagtcgtcggcctgatttggttgaatccattgcagcgtatggactacccaacagagtggcagctgttgtgggcgcaaggacttgttaccccgaacaagaacgacgatatggtgagaacaaagcctgaaaaattctcttcacttcggtcaattggcgcactggtctacggcaaccgaggggcagagacgttcaggggctatcgcaagtacatgaccaagtttccgctactgcttttcaagcgatatgggacaaactcaaagtacttctacacagtgagtcctgacgatcgaaaagactggcgtgaactggcgggtattcgtgtcgagcttgccattcccgatcggctggacgcagctgaatctcaaagttacttgcaagactcgattcgaaaaacgtttttcatcggcaacccacattttccgaaggtatggagccgcagtacgcccctgacgtgcagatcacgcaaggcggtgcaaacgccggcttcacatcactgaacaacgcgctggactatctgcaagcgaaccccgacaagagcgtgtgggtgatgaattgggacgcgccgaatttcccacccaccgacgcccagatcaacgagaacctcgtcgtgctgttcctcgccggcccaaccttcaacaccgagcgcgaaccactcgcgtggatcggcaaggcagcgaccggcaacgccgacgcgttttcgaaaaagtccggcacgacacgaacggtgcaagcgtggaaggcaaccatcgaccaggcagcacgcaacgtcgggattgccgttccggatatcaagtacatcgttcacgatgccggtgccggtagcgacgccgcatcggcgcgacttgtcggcctatcgcagacactcaccgaaatcctgccggagtacgaccacaagaatcagacgttcaacacgtcggccttgctcggcgacatgggaaccggcagcgccttgaccgacgttgcgctggcgatcggccggatcaatcactacggcggcaacgcgctcgtcgcaggcacgaccgacccgaaacaccccgcggccgtcgtggtcatgccgccggccaatctcacgccgatcgatccgaacgaggactggttccgtgcgcgtggcgggaacaacgcttacctgccgtggtgggggcgccgtcacgacaccaactacgggatgcagggctattcatggtgatgcatgccgacgcgcggcgcgttgagcacgaacgcgcccgccacaccaaatcacactgggaatgggttatatgcgaggaatcattcgagtaggcgacctgcacactcacggcggccgggtcgaatccggggcggcgacgagcaaggtgatgggacgcgcggtcgcccgcgtcggcgatgcatgttcgtgcccgcttcacggcgcctgcgtgattgccgaaggagacatggcgttcgatgtcgaaggccgccccgccgcatttcacaatcacaagacgtcctgcggcgcggccttgatatctaccctgcaaacttccgggcgcatctgaatggcacagattcgacgcatgacagccgaacagtttcagttgttgaggctgcacgatacccggatcaagccggtgaaccggtgggccttgtttgaaatcttcgtcaagggccggtcgcagcgcaagctcgccgccgaactcggcatcaccaattccgccatgtcgcagctggtccggagagcgtggcagcgatatctggcattgccgggcaacgacacgcgcctgaccaccctgacgatcacgatccctgccaggtacgaaagcgccttgcatgcgtgggtgcgtgacactcaccgacaggccacgccaatcgatccgctgtgaccacccggtcgagccggaaacgccgcgcccccttccccgtttcgcagacgtcgcgggacatcgtttccgcaacccagagacggggccatctcgcgcggcgccattgatcaagaaacaaattccccaatcgccacaaaaacaaaaccacattccacgttagacccaaacaccgacccattttggatcctttttcccttctgtccccgtatcatttctcccattctgaaagaacagagcaagagacggacatgagcgaacccaccacgctgcactacctcgactacgcagccacgacgcccgccgatccccgcgtgatcgaagcgatgacggcctgcctcggcttcgacggcatcttcggcaatcccgcatcgagctcgcacgccgccggccggctggcgaaagacaaggtcgagcaggcccgcgcgcaagtcgccgcgttgatcggcgcggatgccgacgagatcgtctggacgtccggcgccaccgaatcgaacaacctcgcgctgaagggttacgcggaaaatgcgaccgacaagcgccacctgatcacgagccgcatcgagcacaaggcgatcctcgacacgatggcgaacctgtcgaagcacggcatgtcggtcacgttcgtcgcacccacgcgcgacggcgagatcaccgccgacgcggtcgccgccgccatcggccccgatacgggcctcgtgtcgctgatgctggtgaacaacgagctcggcacgctgaccgatatcgccgccatctcccgcatcgtgcacgccgccggcgcgctgctccacgtcgacgccgcacaggcgctcggcaaaacgccgatcgacgtgcgcacgctcggcatcgacatgctgtcgatgtccgcgcacaaggtgtacggcccgaagggtatcggcgcgctgttcgtgcgccgcgacatcgccaaccggatcgccccgcaaatccacggcggcggccacgagcgcggcctgcgctcagggacgctcgcgacgcatcagatcgtaggcatgggcgttgcatgcgaactggccgcggaaaagctcgacggcgaagccgcgcggatcgcggcgctcggcgcgcgcctgacgaacgcgctggccgcgctcggcgacgtcacgcaaaacgcggccaccgcacgccgcatcccgcacacgctgagcctgacggtgaatgcgcccggcttcttcccgttcatgctcgacgaagcgctcgccgtgtcgtcgacctccgcgtgcaactcggccagcggcgcaccgtcgcacgtgctgaccgcgatcggcctcgacgcggagacggcgggccgcaccgtgcgcgtgagcttcggccgctttacgacggagcaggacgtcgatttcgcgatcgcctgtttccgccgcgcgatcgagcagtgccgtgcgacggccgcgaacgggttttccgcttcgcggcagatcacgccggccgacctgaaggcgatccgcaacgccggcttccgctcggtgatctgcaaccgtcccgacggcgaaggcgtcgaccagccagcattcgacgagatcgccgcggcggctcgcgaactgggcctcgacgcgcgctacctgccggtcgagcgcgaccgcatcggcgaggcggaagtcgacgcattcggcgcgctggtcgatacgctgacgaaaccggtgctcgcatactgcggaagcggcaaccgggccggcatgctgtggaatcgtttgtgcgcccggcgcacggccccggtctcggcctgaccctcacaccgccgcgtgacgcgaacatgccgcgcgctcgggcgtctcgggcaagcccgggcgccagtgaattccggcacaatgcccgtcgtgtccgtcacccgaaacccgcatgccctgcccgtcaaattcccgcgcgcggaagcgcgctggcgccgacacccttcctccgacagcccctgcaaccggcagcatgccggccgggccgccgcgctgctgcttgccgtgagcctcgccgcgtgcgacgcgacgcccgtccctgaccggctctcggacttcgatgcgacctacgcgatgcaggagcggttcggcctcggcgacgtgttggtatttctcgggtcctgcatcggcgccaaaaacccgacttatccgggccaggccgcctgcaccgctgtcatctactcgaacggccacgggtcggaaacgcaggccgacttccactggaacgggaagaaatgggtggccgagcccaccgcgtcgcaggatctcctgccttaccccgatcccaagctcgcagagtgggtgaagtaagcgcgcgcgacgcgccgctacttcggatactccagttgcagtgcgacccagcccgatgtcgcgtcaccgtagcgtgccgcgatgtctgcaagcacacccggaagcaccgattcgccacgccgtccggccggcatcgccacgcgcgcgtgcccggcagtcgccggctgcgccagcaaccgcagcccgtgcctcgactcgatcacgcgcgcgcccgccgtcgcgacgacgtcgctgcgccaggtccgcgcccacgcatcggccgtcagcgcaaccggaagctcgtcgaacccgtcttcgaccggaagatcgaacgtctcgtgccgccagaacgcgaggcggttcgtcaatgcgaccgccaccgccggcgcggtcaacacgaaccggctgccgtcatgaacgtcgctccatgcctgcgcaccgacgcgccgcgcggtctcgcgcgccgcggccggccccgccagcgcattcaccaacgccagcgaagcgggaatcgacgccgacacgccggtcgtcgtcatgacgtcgccgtccatcacgtagcggcgatcgtcgacccacgtcgtcccggtaaagcggcgacgcaggcggtcgcgcgaataccagtgcgacgtcgccgtgcgatgctggagcaggcccgcgttcgcgaggacttccgcgccatcgcagatcgccaccatcgtcgcgccgccgacggcctgcttgcgcaaccacgccagcaccgccggccggtcggcaccgtgcagcgcggggacgatcacgacatccgccccggctggaacggccgcgtcgaaccggtcgaacgtggtgtcggccagcatgcgcaacgcgggcatcagttcgacctcgccttcgtcggccgacacggcgacgacatcggccgcaccggacgtcttcagaatcgcgtacggaacgatgaaatcggtcgtctccgttcctgcattgtccgcgacgatcgccacgagcggccgcacgcggcccgccttcggcgcgccgaccgtgagcgctcgcgcgaccggcggtgcgtcctccgccctcaccggtgccggccaccccgccgcacacgcgcccagcaccgcgcacacgagcagcactgccccgcctgtcttccctgaccgcatcgtccacccgtatccgtcgattgcacgtccggaaaattacagggatcatgctcgcggtcacaaggacaactccaccgcactttccgccatgtcccagtcaacctgttcggcacgcgacatcgttgtcgtcggcttcgaaggcgtccagtcgctcgacatcacgggcccgatggaagtgttcgcggtcgcgaaccgtcatcttcccgaccatgcgctgccgtaccggctcacgctcgcgtcgcaacacggcgacgacatcgtcacgcacgcgggcctgcgcctcgccggtacggccccgctggcggcattgccggggcagatcgacacgatcgtcgtcgccggcggcaatgaagcggcactgcgacacgccgcgtcggaagccggcgtgctgccttggctgcgcacgcgaatcgcggacacgcggcgaatcgcgagcatctgcacgggtgcgttcgtgctcgccgcgggcggatggctggacggcaagcgcgcgaccacgcactggaaccagtgtgcgacgctgcaggcgctgtgccccgacgcgcgaatcgaaccggacgcgatctacgtgagcgatccgccgtttcatacgtcggccggcgtgacggccggcatcgatctgtgtcttgcactcgtcgaggcggactgcggcgcgccgaccgcgctcgcggtcgcgcgcgaactcgtgctgttcgtgcaccgtcccggcgggcaggcgcagttcagcgtcgggctcgatatccaggccaacgcgacgccgcgcatgcggacgctgctcaccgggatcgccgacgatccgaccggcgatctcggcgtcgccgcgctggccgcacggatgcacatgagcgaacgctcgtttgcgcgcaacttcctcaaggaaaccggacaatcgccggcgcagttcgtccttgcggcacgcgtcgagcgcgcgaaggcgctgctggagcgggccgactggccgctcgagcggatcgccgagcggtcgggattcggcagcgtcgacgcgttgcagcgcgcattcgcgaagcaggtcggcgtctcgccgcgcgactatcgcgcacgcttcggcgtgaggcgcgaccggcagcggatcgcgtaggccggcgcaccgcgcaatacgcgttccaggatacgttgaacctgaaccccgtcgcgtacctgcgggccgtgcgcctgaatcacgcacgccgcgagcttcggctcggcgattccgagacgtccgcggccaccaaatggggcttccggcacctgagcagtttcgcgcgggactatcgcgcgatgtccggcgagttgccgtcggccaccgcgaagcgctacgcgcgccacgcaacctgaacgcttgtcaccttccggcagccggtgcgaacgattccgcaccggccgccgccctgccggctacgtcactcgtcctgctgatcctgctgtgcctgcacctgccgctgccggatgaactgccgcacatcgctcatcgtcacgcggccggtgtgcttcgcatcgatctcgtcgaagtgcttcgacacgaagcccaggccgctgctctgcgcctgcgccttcgtcacggccgcgccgttgctcagcaccgtattggcgccgagccgtgcatcgacacgctgctgcgcctgctgctgcaacgtcgcgccggtcgacggcagcaccggcgccgcccgcgtggcaggaaagaacggaccgtcgacaccgtgcccgccgtgcggcagcttcaccggcgccaccgactgcggcggcaacgcgtgggcactgctcatcacggcaccgaggacgatcaacggggacatacgccgcatcaaattgattagggacatgatcactcgcattcaatggatgaatagagggttcctttgacaaggagtccgtcgctcaaggggccgccgccagcgtcgtcgcggccgccgcgccgggacgctgccggtcggcacgcccggcgggttttcatccggccacggcggcggcagcgtgtgcagcgtcagtgccgtcggaatccgcgcgcccttgtagaacgtcttcaggtcccgcttcatctgcggacgggcgacgtcgtccaggtagatcatgtggccgccctggaagaagttcacctgcagcttcggattcaggcccttcaccgtctgcagccgcgcgagctgcttctcggtgttgaagaacggcgtcgcgagatcgtggaaaccgttctccgcgagtacgcgcagcttcgggttgagctgcagcgcaccgagcagatcggggatcgtgtcgggcatcggctggccgtcgtgcgagaagtcccagacgccgatgatgttgtcgttcagcggcaggtacgtcgcgttcggcgcggtgtagccgaggtaatccggcatctgcgtcgcaagcgcgttcgtgaacggctgcgaaatcaggatgtcggacgggtcgccgtcgttctgcagccgcggatcggagttcggcaacgacacgcgtccgtcataccggccgatcgtcgtcccgggcagcaggctcgtgccgaacggattcgcgttgaagtagccgcgcagcgcctgttgcgtgaggctcgacgggatcgaccacagcttgagcgtcgcgtcgctcgggaacaccggtgtgccgagcgcatccggaatgccgagctggctcaacacccacgactgcgaatacttctgcagctggttgtagatcagcgtcgtgaacagttccgtctgcagtgcgtacagatcctggttcaccggtgccggtgaaacctggttgaagtacgccgcgaccgccgcataaccgggcaggtaaccggccacggtatcggtttcgagcagcagccctccgtcgactgcgtgatcgccacggcttccaccgcatccgcgaagtagttcaggatcgccgactgcagcacgatgcccgtcaggtgcacgccggccgattcgagcgccagcgcgagcatgtcggtacgcggcgtgccgtacgattcgccgtacaggtagatcggcgacgtgctgcggccgttgacgttcaggtagcgctggatgaagtcgcgcatgatgttcacgtccgcgtcggaactccagtacttctggttggtgttcggcaacacggcttccgacagcccggtgccgggcgggtcgatgaacacgaggtcggtggtgtcgatcaggctgtcggcgttgtcgacgagcggatagttcggccagttgctgccgaaccccggatcgggcgtggccacgcgggtcggcgcgaacgagccgagtcgcagccagatcgacgacgagccggggccgccgttatagacgaacgtgacggggcgcggcttgccgttcgtgctcggcgcggtgtacgcgacgtacgacatcgacgcctccgcattgccgttcgcgtcctgcgcggtcaggtggccggtggtcgtcgtgtagttgacggtcgtgccgccgtttttccactggtaatgcatgacggccgctttctcggacacctgggcgggcgcgaggccgtcgcccgcgttcaacgaataggcgacctggtcgacgtaaggctggttggccgccggtgtctggctgccggccgcttgcgcgctggcctgctgactggccgttgtctgcgcgagactcgatgcgccgacggacgacgaatcgtcgccgccgcacgccgagagcgcgagtgtcatcgcggtcaatgcgcctagcccggccatccggccgcgatggccatggctgccggtactgctcctgtctggtttcatctcgttccttgtggctggttcggataccgcttcacaaaggccgccctcactggcgagacgcgcagcaacacccgccactcgcgcaaaggcggttgggatcggactgcttcaagagactgaacgtgatacagacacagcaaactgctggcgagaatcgtgcttgaaccgcccctgcagtttggacttcttttctgattaccgaaatttacgacatcgacaaaataggcggtgctgcgccgcgttgtcaaagatcattccgatattaaaaatcccgcaatgatgcgaagggccgccagtgtctggcatttgaaagaaaacgggattattcgtgcaaggtgcgtcttgtcggcaatgccgcgccgaatattttacttttcgcgcccagcgacgaagcctttactgcattgatgcagcacgctcaataccttcagatcgacaggatttttctttcatttttattatcgccaatcgattaatgcattgcggcgaaatgcaggcttgattcgaagattcgattcacttcaatcattcttcaatccggggcttatgcatccccgtcatccataaaataccgatttcgcggaattgcatcggttcaagcggaattatttacccgatatccggccgggtttgtcgatgcgcgagcggcgtgcgattcatccgccgccgcccgcgcgacgacgtgcgcacgtgccgcacgtcgtccatcgcgaagccggttcaacccgcgctcaatgcccgccgcccggcagcgcgatatcgatcagcaccgggtcgtgatccgacgaacgatacgcatccggcgcgtagaacgtcttctgctgctccgccgatttgtaggcgagcgtgtactgcagcgcgagcggctcgtccgcgttgatgtgccattcgtgcacggccttcacgtgcgacgcgagcggcagtgtcgcgagcgcgtgatcgagataaccggcttcgccgttgtacacgtagctgtacgcattcgcgccgatccagcgcgcgacgaggttgcggtagccgcgcgattcgagcgtgcggatcgggtcttcgtacgtgtagctgttgaaatcgccgatcagcagcacgccctggcccgcgacgcccgtcgggttgccggcgagccagtcggccaccttcgccgccgcgcgcgtgcgcgtcgggttccagcaaccctggccgtcaccctggtcgagatcgtcgttcgtcgcgtccgggcagttcttcgacttcaggtggttgaccgcgaccgtcagcgactgcttgttgccgccgaccagccggaacgactgcgcgagcggctggcggttcttgtcgtcgatcgcgagcgtggccgcgcggccgaccggctcgaccttgcggctgtcgtagatcatcgcgaccgcgatcgcatcgccgccgaggcgcgacacgcccggatcgaccacgcgccagtggttgccgagcttcgccgcgagctggcgcaccgcgctcagttcgccatagccgttgttctggatttccatcaggccgatcacgtcggcgtcgatcgccttcagcgcgctgacgatcttcgcttcctgccgctggaattcctggaagttcttcgcgccgcggttgttcggatcgtcgaagccgccgccgagaccgttgccgttgaagtagttgaggacgttgaacgacgcgacgcgcaggttcgatttcggatcgcgcgcgggtgcgttggtgcgcgggttcgtgcgcgcgtcgaatgccggcacggccgcgccgggcagcggctgcacgcgccatgcgccgtaacgcacttcgagcacgccttcgacgtcgcgcaccgtgtagcccgcacgcagcgtgttcgcggccgacaggcccggcgccggatacggcacggtcgcggggttctgcttgttcgagccgtcgtcgaggacgagacggttgcgtgcgttcgcatcgatctgcgtctgtgcctgcgcgggcggcacgacactcgtcggcgtgcgcaggcgaccgttgctgagcatcacgctgccgtaacggccgagttcgtagttgtcggtgacgttcagcgtctgcggcaagcgcaccagcatcccttcatacgcggcgaacgcgttcgggctgtcgaccggcagcgtgagcgtcgcgggcgtgacggtctggccgttcgcgcacaccgcgatcgcgcccgactgcgtgagctgcgtctgcccgtacttctcctcgaccttgcccgtcacgtgcacgaggtcgccggccttcgcgcgcactttcggcgcatagacgaacaggccctcggacacgcccggctggttgcggcgctgcgcgtcggcctgctggacgaagaagccgccgaagccgtccgtgccgccgaaatcggcggtgacgacggcttcgatcgacacgttctggccggcgagcggcgacggcgcgcccggcccctggatatcggcgatcggcgtcgtgctgccgccgcagttcgggctgacgggcgcggcggtggcggcgaaaaccggcgcggcgagcgtcgggagcagcaatagcggggcgaagaggcggattgtcgagcgcatgacggggaatcccggttgtgagggtggcgaaagcttagcggcgctcaatgacagtttttggtaatcggaagacaggctgatgtaatcgtcgtcatcacgctgcgatcgccaccgatcgcacgttcgggcctgaaaacgcggggaaatcgtccggcaataaattcgtcgtgctcgcgacgattccccgcgtgccttcgcgcatggtccgccgcgctataccgtccccggcaacgcgctcgacacgagcacggccgccaccatcagcacgccgccgagcacgaccgcctcgatccgcagcactgtgccgaaccgtttcagcgaaacagccggcatcgcggcggctgggtccttcagcgcggccaacagcttcggcatcccaaagaagcggttgtgcccgccgagcgccgcggcgatcagcaccagcgcgagcttcagcagcaggatctgcccgtacgtcgacgcgagcaggttggcgggcgtgtcgacgccgcgccagccgttgtacgcgccggtcgcgaacagcacgatcagcgcatatgtcgatgcatcggacagcgactgcacgaacgatgcgcccgtcgtgcgttcgctcgcgggcaggccgacgagccgcggcatcacgccgaacgccgtcacgagcacgagcccgacccatgcgctgatcgccagcagatgcagccagtcgatccacaccggcacgctgaacagccctgcgtccaccggatgcccgccgttgctgcgcgcgagcgcgacacaggcgagcgcggcccagatcgcgaacggaaagcgcgaatcgtgcgctcgcctgacgaacgacagcagcacgacgacgagcatgaatacggcgccggccagccacgcatgaccgaaccccgtgcccgcgagcatcgcgcggacggacggtccggcgtcgagcatcgacacgtcgctcatcagcgcgcagtgcgcccagaacgcggtgatgctggcaagcagcgacacgacggacgcgatgcgcagcgtcgcgacgagccgccgcccgatgccgtgctgccacgtcgacgcgccgcgcgcgagccagtggctgccgagcagcgcgccgacgacgacggcgaacccggcattctggatcgccaccgacacgagccgcaggagaccgacgaagccgtcgttcaccctttcaccttgaacgtataggcgcccttcgtgcgatgcgcatcggccgtcatcgcgacccactgcaccgtgtacgcgcccggcgcgagcttcggcatcgcaatggtcatcacgcgcgggttcgacgcatcgaccttcgccttttcctgcgtgacggcgttgccgttcgcgtccgacaccttcaccgaactgaacgtcggttcgaggtcttcgttgaatgcaagccgcaacgtgtcgggcgccgtgtcgaccgtgctgcccgtcgccggtgcggcgctttccagcttgccgtgcgccgatgcggcgaccggcgcggccgcgacgatcgtgccggccgcggcgacggcggccagccgcctgagagtcgtgatcttcatgttcatgcctcgcgtcacggcttcttcagctcaacgacggtcagcgcgccgcccacgtcctcggcgacgaagtcgatcttgtcgcccaccttcacctgcgacagcatcgccgggtccttcaccttgaacaccatcgtcatcgcgtccatcccgaggttctcgagcgggccgtgcttgatcgtcagcttggccgcagccgtgtcgaccttgcggatttcgccgtgcgacatgctccgctttgccgcggcttcctgcttcgcaccaccgctcatttccatgccggccatgtcgcccgccgcgtacgacgcggcggaaaacgccagcgcccaacccgttgccatcaaaaccagtccctgcttcatcgtgtcgactcccgtgtgagtgaatggaaaccggcggccgcatcggtacggccgccgcatgctgctgctcaaccgtccgacagttcgccggtgtactcgtacgcgacggtgcccttcggatgcctgaaccagcccggatcgcgatagtcgttgcggccgaggccctgccgcaccttgcagaccgtgaacatgccgcccatctccagcggcccgaacgggcccgtgcccgtcatcatcggcagcgtgttgtcgggcagcggcatctccatgccgcccatcgcgccgcccgtgctgcccatcgccatgtagtcgggcacgagcttgccgatgcgctgcgcgagatccttctgcggcacgccgatcaaattcggcacctggtggcccatcgcattcatcgtgtgatgcgacttgtggcagtggaaggcccagtcgcccgggcgatcggcggtgaactcgatcgcgcgcatctggcccaccgcgacatcggccgtcacttccggccagcgcgccgccggcggaatccagccgccgtcggtgcccgcgacttcgaagctgtagccgtgcaggtggatcggatggttcgtcatcgtcaggttgccgaaacgaatccgcacgcggtcgcccgcacgcacgggcagcggatcgatgcccgggaacacgcgcgaattgaacgtccacatgttgaagtccgtcatctcgttcacgcgcggcgtgtagctgcccggatcgatgtcgtacgcggcgagcaggaacacgaagtcgcgatcgaccggcatcgtgccgcgatccttcgggtgcacgatgaacatgcccatcatccccatcgccatctgcaccatctcgtcggcgtgcgggtgatacatgaacgtgccgtgcgcctcgagctggaactcgtagacgaaggtcttgccgggcgggatatgcggctgcgtgaggccgccgacgccgtccatcccgttcggcagccgcagcccgtgccagtggatcgtcgtgtgctcgggcagccggttggtcacgaagatgcgcaccttgtcgccttcgacggcctcgatcgtcggcccgggcgactggccgttgtagccccacaggttcgcgttcatgccgggcgccatctcgcgcacgacgggctcggccgtcaggtggaactccttccagccgttcttcatccgccacggcagcgtccagccgttcagcgtcgcgacgggcgtgtacggccggccgttcggcggcacgagcggcggctgcgtgccggttttcgccatcgtgggcgcttccggcaaggacgcggcgccggccttgttgaccatcgccgcgccgagcagcgcggcgcccgagtggctgagaaattgtcgacgggacaccatgtcaatgaccttccggatgcgtttgcgtcgcgggcgccggtggcgccgcggggtggaagccggctgcggcgcagcgtcggcattggaagcggattccggccgggcagatggcgttgcacgcggcacgtcgcccggcgtcggcagccgcccccgacggccatctgcagatcggtttcggcgagccagtagtccttcagcgcatcgatgtagccgttcaccgcgccgacctgttcgcgcgcatcggccagcagctcgaacacgctcgcgagcatcccgttgtagcgcagcagcagctcgtccgagatcgtcttgcgcagcggcacgacttcgtcgcgatagtgggtggcgacgtcgtagctcgtcacgtaggccgcatacgattcgcgcacttcggaacgcgcatcgatggccgttttcgcgagccggttcgccgcctgcatgtagacggcctccgcccgcgcgaccttcgcgccgccccagtcgaacagcggaatctcgacgctgatctcgaagccgtgctcgtgccccttgccggtctcgtagtcgttcacgtagccgagatccaccgcattgacgaagcgcgtggccttgctcagtccgagcgacgacgcgacaccctgcgtctgcagcttcgcggcctggatgtcgaggcggttgcgcatcgcgaagcgttcgagatcgggcaggttcggccgcgctttcggcaggtcgggcaagcgctcgggcagcgcgtattgcgtgcgttcgccccacagccccatcgcgcgcgtgagcttctcgcgcgcggccaaggcctgctggcgcgccttcgcgtgctgcgcgaccgcatcggcgtggaacgcctgctcccgcgcgtaatcgaggcggctgaagttgccggcctgccgcatgcgctgcgccagttcggcggccgcgctcgcggcatcgcgcacctgccctgcatagttcgctgcctgttcggccgcgacggcctcgacatacgcgcggcgcgcgtcggcggccaccttcagcatcgcgtcggcggtttcgagcttggtctgctcgaagcggcggcgttcgatgttcgtcgcgagcggcagggtcagcagcgcgaacacgttcgccgagaacgtgcggccgagggtcagctcgccgtcgcccgcgcgcgtgcggctgaacgcgaaacgcgggttcggcagccggccagcctggacgagatcggcctccgacagccccagttccgcgtacgacgcctgcaggccacggttgttcagcagcgcgacctgcacggcgtcgtcgatcgacagcggcttggccagcagttccttcgtgcgcgtgtcgacggcttcacggtcggcgtcggtcctgaccacgaccgcgtccttgccgatgcgctccgacgcgacggacgacaccgcatcgaaaccgccgtccttcgaaaacgtcgtgcagccggcgaggaaggccagcacggccgcggccgcgccgatcctcggcgagatcgacagcatcgtcatcgcgcggcctcctcgtgcatcgaacgggtcgcgccgccagccgcacgaccggtcgtgcgcccttcgcgggccgttccgtcacgtcgcggttcagctgtttccagcccgggccttcgtcgtcacgatacggccggtagccgtcgaatgcggatgtcacggtgacgtccggcaccgccgcggcggcgtccaccggatcgggcagcggggtttgcgcagacgcgagcgacggcacgatggccgccgcgccaagcagcgccgcagtaatcaatcgcatgaatgggtctcgtcgtgagtcgtccggcggacgggatgccgccgccggagcggattgcggagcacggccggtcggggccgcaggcggggtctagacgagaagccggcgcggcggcctgtcgatgccgccggtcaggaacgacacgaccccggccgcgggcggtggcgagacgatcgccgcgcgaacgccggccgcggcggggacggcgggcgcgcccgacatgccggcgccgacgcagcaggacacgcacgcggaacacgccggcgcatgccgggcgtggctgtcggcgtcgtgatggccgtcctgcgcggccggcatcgcgtgcgacgccgcttccaccggcgcgacggcaacgcgttcgcactgcatcgaaacagtcgcgaacgactggatcggcaggctcagcgccagcagcacgacgaggaggaatttgcgccagtacgacatggatgcggaatcaggcaggcaacgaccggatgggccggcgcggcgccgtgacagcgcgtgccggggacaagacggccgcagcttatcgccgtcgcggtgacgacgacatggccgaaacatgaccggattgtcatgaaacgcgggcgacgcgccgcaagcgcttcatgacaattccgtcatccggcggtcattcttcgcgcacgctcggcgccctatgctcacgcgttacactgaccggctggaatcacggacagcctgcctcaccatgcggatactgatagtcgaagacgaacccaagatggcgtcgtacctccggaaagggctgatggaggcgagttacacggtcgacatcgcggaaaccggcaaggacgggctgttccttgcgctgcacgaggatttcgatctcgtcgtgctcgacgtgatgctgccggaaatggatggcttcgaggtgctccggcgcctgcgcgcgcagaagcagacgcccgtgctgctgctcacggcgcgcgaggcgatcgaggacaaagtcgccgggctcgagctgggtgccgacgactatctgctcaagccgttcgcgtatgccgagtttctcgcgcgcatccgctcgctgctgcgacgcgcgccgcgcaacgtgcgcgacatcctgcatgtcgccgatctcgaagtcgacctgatccgccgccgcgtgcggcgcgccgacacccgcatcgacctgaccgcgcaggaattcgcgctgctgcagttgctcgccgaacgcgaaggcgaagtgctgacgcgcaccttcatcacgtcgcagatctgggacatgaatttcgacagcgacacgaacgtcgtcgatgccgcgatcaagcgcctgcgcgcgaagatcgacaacgcccatgagaagaagctgatccacacgatccgcgggatgggctacgtgctcgaggatcgttcgtgacgcgcagcagcccggcctcgtattcgctgctgcggcgcctgacgctggcgttcgccgtcgtcgccgcgctcgtgttcgcgctgaccggcgcgtacctgtatcgctcgctgtccgccgagctgacgcggcgcgacgacatcgagatctccggcaagctcaaccagttcctgcagcttgcgcacgcgagcggctcggctgccgcgctgcgcgccgatccggccgtgtttcatgaagtgctgctgtcgcatccgggcgtctatctcggcatctacgacgcgcggaaccgcgcgctcgtcgagcattccgacgaagccggccacacgctggcgtcggtgatcgccgcgccccatccggccggcgcagcgggcacgccgttcacgtgcgcgccgcccggcatcggcacgtcgcgctgcgtgtatgcgcgcgccacgctgccgtccggcgatgcgatccaggttgcgcttgcgcgcacggcgaccgatcgccagtcgttgctcgaaagctaccgcgtcgacatctggctcgcggcggccgcgggcgcgctgctggtcggcgcgctcggttacgcggtcgcgtcgcgcggcctgcgcccggtcgagagcctcggccggcagacgtcacgcatcgaggcgcacaacctgaacgcgcggctcgacgcgcggggcggcccggtcgagctgcgtgagctcgcgacgtcggtcaaccggatgctcgaccgcctcgaacgcgcgttcgtgcggctctcccagttctcgtccgatctcgcgcacgacatgcgcacgccgctcgccaacgtgatcagttcgtcgcaggtcacgctgtcgcgcgcgcgcacgaccgaggaatacgaagcgctgatcgattcgaacatcgaggaatgcgaacggctgcagcggatgatcgagaacatgctgtttctcgcgcgcaccgacaatgcgcgtcagcacctgaaaaccagcgaacttgacgcgggcggcgagttgcgccggctcgcgtcgtatttccaggcgcttgccgatgaagccggcgtaagcatcgacgtgcaaggcgaagcgaccgtcgccgccgatgcgacgctgttccggcgcgccgtcagcaatctcgcgtcgaacgcgctcgaacacgcgcaagccgggtcgacgatcgagctggcggtgtccacgcaaggcgggtatgcggtcgtcgaagtcaccaatcgcggcgccgcgattccgcccgaacaggtcgaacggatcttcgagcgcttctaccgcatcgattcgtcgcggcacggcgcggcgcgcaacgcgggcctcgggctcgcgatcgtgaaatcgatcatggaactgcatcgcggcaaggtcgaggtcgcaagccgtgacgggcgcacgacgtttgcgctgcattttccgcgcggcgtcgaggggtaaggcgtttcccgcgcgtgtcgcgtcggcatgacggccggcgcgacaccaggcgaagcgcgacgacgacgccccttcactctcccggttcgcgccggattttcgcctggcggcgattgcggtcgttcagtatctggtgccggcgatggtcggtcagcttcttccagtcacgcgcctcgtcgcgcgtgcgcaggcagccgacacaaaagccggtccggccgtcgaacgcgcacagttcgatacagggtgatttcacggccacggtcaggccgccttcgcaggcgtcatcacttcgacggtcacgtgcgacacgccgtcgaaactctcgatcagcgcgtggtagaaacgcgcgtcgcgccccgtctcgacggtctcgaccgacacgatcgcactcatgtggcccgggccgacacgccacacgtgaagatcgttgaccttgtcgcccagcgcctcgatcgcatcacgtatgcgcgccgccagtttgcgatccacgttgacgtcgagcaggatgccgccggtatcgcgcatcagcccgtacgaccagttcgtgatcacgagcgcgccgacaatgcccgcgacggggtccatccagacccagccgaatgcacgtgcgagcagcaggccgacgatggccagcaccgacacggccgcgtcggcgatcacgtgaacgtaggccgaccggatgttgtggtcgcgatgggctgccgtgtgcgaaccgtgatcgtgatgcgcatgatgatcatcgtcgtgatcatggtcgtggtcgtgcccatgatgatgaccgtgcccatgaccatgcccgtggtgatggccgccgctcagcagccacacgctggcgaggttcaccgcgagccccagcacggcaatcggaatcgcttcgccgaaatgaatgggcacgggcgccagcagacgcgcaacggcctcgtagccgatcaggatcgcgatcatcgcgagcacgatcgcgctcgtgaagccggccaggtcgcccagcttgccggtgccgaacacgaagcgcggatcgtcggcatgcttgcgcgcataggtataggccaacgcggcgatcagcatcgcgcccgcgtgcgtcgacatgtgcaacccgtcggcgacgagcgcgagcgacccgaacagcgtgccgccgacgatctcggccaccatcattgccgagcacaggccgatgaccatccacgtcctgcgttcgttctgctcgtgcgccgcaccgaggaagatatggtcgtgccccgcgccgaacgcgtcatcccggaaagcgttcatgtcctgcctcgattacttgaaatagctgtgcaccacgtcgatcagctgctcggtcgcgctgccttcgtgtgcgtcaggttcgtgcgcatcgaccagatgctcgcgaatgtggtcttccagcacgacggccagcagcccgttcatcgcgccgcgacaactcgtgatcaattgcaggacctcgttgcagccgcgctcctccccgagcgcgcgctcgatggcctcgacctggcccttgatccggcgcacgcggttcagcagcttctgtttttcacgaacggtatggctcatcgacgacgggctcctgaatagggaggggagtatatatccggaagggttcccgtataggagagaggggtatatttttcgagatgaaggcttgtcgaaagcaacccgctcggctagactgcccttcgtctttgggagtagcctgctttccgtctccggaaagcgaacgcgtcaacacactcggcctgcggccgtggcgcgttcagcctgatcggcctggcgagaccatcggcacatcgcgtcgttcctggtcggacgtcggcggatgtgccatggttcgtcaacgtccgaccacggagtccccatgttccccgccgccctctccccgcgtttcgccgccgtccccgtccgcacgcatgcctgcggaggtgccgcatgacgttcatgttcgtcgaactggcggtcatgctgatcgtcatcctcgtcgccgccgaggtcttcaccaatgcgctcgagcatctcggcgaacgcctgaagatttccgaaggcgtcaccggttcgctgttcgccgccgtcggcaccgcgctgcccgaaacgatggtgccgctgctcgcgatcgccggcggcacggcgaacccggccgtgaacgaggagatcggtgtcggcgcgattctcggcgcgccgctgatgctcgccacgctcaccacgttcctgatgacgctcgcggtgatccgctcgcgcgggccgcgcggcacgatcgcgcccgaacggacgggtttcgtgcgcgacctgaactacttcctcgccgcgttctcgctggccaccgccgcgatgttcgtcccgcatcacaacagcgccgtgcgcgctgctcgccgcgatgctggtcgggatctacgtgatgtatgtcgtgatgacgttccgtgcgtcgaaccagctcgtcgatgccgggcatggcaccgaggcgccgcacaagatgttcctgtcgcgcctgggcgtgcagaccaatcttgcgaccatcgcgctgcagttgctcctcggcgtcgcgctgctggtcggcggggcgaagggtttcattcacggcgtggaaggcgtgtcgcacgtgctcggcgtatcggccctgctgctgtcgctgatcatcgtgccgatcgcgacggagctgcccgagaaggtcaacagcgtgctgtggatccgccgcgggaaggacacgctcgcgttcggcaacatcaccggcgcgatggtgttccagggcacgctgctgccggcgatcggcatcatgctgacaccgtgggagccgcgcctcgaagtgctgaccggcgtgatcgtgacgctcgcggcggccgcatggctgcgcgtcaacgcgcgcccgcgggctcgcgatctgggcgttgctggcgaacggcgcgggttacgcagcctatctgttcctgacactggcccggtgacccggctcacccggtacgggcacgctggcccggcgcgaacgatgcaccgccgcgccgcgtgcccgcgagcggttcagatgcgcgcctggttcacacgctgcgacagctgttcggcgctttccttgcgctcgctgtaccggtccgtcaggtacgcgccgacgtcgcgcgtgagcagcgtgaacttgaccagttcctccatgacgtcgacgacccggtcgaaatacgcggacggcttcatcctgtcgtcgtcgccgaactccatgaacgccttcgcgacggacgactggttcggaatggtcagcatgcgcatccagcgcccgagcacccgcatctggttgaccgcgttgaacgattgcgatccgccgctgacctgcatgaccgccagcgtcttgccctgcgtcggccgtaccgcgccgaccgacagcggaatccagtcgatctgcgctttcatcacgccggtcatcgcgccgtgccgctcggggagcaccacaccatgccctccgaccattgcacgagctcgcgcaactccgccaccttcgggtgatgctcgggtgcatcgtctggcaacggcaagccggccggattgaagatccggacatcggcgcccatggccgtcagcagccgcgccgcctcctcgaccagcagccggctgaacgaacgcgcacgcaacgaaccgtagagcagcacgatgcgtggcggatgcgtcgacgggcgcgcgggttgcagctggctcgcatccggcacgcgaaacagcgcggcgtcgagttgcgggagatcgttcaggcagtcagacacgcttgccctccgcatcgatcacgatttcgccgtcttccttcgcaaacggcccgttctgcggatcgggcaggatgtcgagcacctgttcggacgggcggcacagccgcgtgccgagcggggtaacgacgatcgggcgattgatcaggagcggatgcgcgaccatgaagccgatcagatcgtcgtcgctccatttcggattgtcgagatcgagcgcgtcatacggtgtgcccttgcgacgcagcacgtcgcggacggggatacccatcgccgcaattagcgcgcgcaactcttcttgccccggcggcgtgtcgaggtacagcacgacacgcggttcgacgccgctgttgcgtatcatcgccagcgtattgcgcgacgtgccgcaatcggggttgtgatagatcgtgatgtcggtcatttccggaatcctgaatggtttcacgcgcgctcgtaccagcccttcgaacggttgacgacgcgcacgacgagcagcatgaccggcacctcgatgagcacgccgacgacggtcgcgagcgccgcgcccgagtggaagccgaacagactgatggcagccgccacggccagctcgaaaagttggacgcgccgatcagcgccgacgggcacgcgatgctgtgtttctcgccgacgacgcgattgagcccataggcgagcgccgcgttgaagaatacctggatgaggatcggcaccgcgagcagcgcgatcaccagcggctgcttcaggatcgcctcgccctggaacgcgaacagcagcaccagcgtggccagcagcgcggcgatggaccaggggccgatcttcgccatcgcgcggtcgaacgccgcctgcccctggcgagcaacagcctgcgccacgcttgcgcgaggatcaccgggatgacgatatagagcacgaccgacgtgagcagcgtcgcccatggcaccgtgatggcggacatccccagcagcaggccgacgagcggcgcgaaagcgatcaccatgatgctgtcgttcagcgcgacctgcgacagcgtgaacagcggatcgccgccggtcagccggctccacacgaacaccatcgccgtgcacggcgcggcggccagcaggatcaggccggcgatataactgtcgatctggtcggccggcagcatcggcgcgaacagctgccggatgaacagccagccgagcaaggccatcgaaaacggcttgacgagccagttcacgacgagcgtgacgccgatccccgcacgtgctggcgaacctcatgcaacgcgccgaagtcgaccttgacgagcatcggcacgatcatcacccagatcaacaacccgacgggcaggttgacctgagcgtattccaggcggccgatgcgctgaaagagccccggcagtgccagccccagcgcgatgccgagcacgatgcacagcgccacccagacggtcaggtagcgctcgaatgatccgatggcgagcctggccgccgcggcttgcgacggggccgcgttcgagccgctcatgtgcgatccccgcagcaggccggcgccgccggcacgccgcacgcagcgccggcgcagcagttttcggtcaggaacccgatgaggccgctcatcgattcgaagttcgccgcgtaatagatgaaccggccgtcctgacgcgcggtgaccagctccgcatgcgacaaatccttcagatgaaacgacaggctcgatggcgacagcccgatctgctgggcgatcgcaccggccggcagcccttgcggcccggcgacgaccagcgcgcgaaagatggccaggcgcgcttcatgagcaagcgcgcccagggcgcgcacgacgagattggagtccatggcgcgaaggatagcgccttcatttccatatttcaagaattgttgaaataaagatgccgagcccctgccgaacggcataaccgggctgcacccgacccgccgcgcatcgtcgaacgccgccgcgcgagccgcatccggcccgacatgcgcggcgccggtgcggccgccgccccggttcacggatcggcgaggcaccggcgcgccgtcaggtcaggatgccttcacgagcttgacgatcgtcagcgtgccgtcgaccttctcgatccgcaccttgaccttgtcgcccgcatgcgcgtgctcaagcatcgccgcgtccttcgccttgaacgccatcgtcatcggcggcatcccgacgttgtcgagcgcgccgtgcttcagcgtgatcctgccgctcgcggcatcgaccttcttcacttcggcatcggtcagcgcggcgttcgactcggccgcactgcccgacgacatcttcatgcccgacatgtccatgccggccatgtcgccggcggcgaaggccggcgcggtgaaagcgccggtcgcgagaacggctgcggtggtggtgacagtgatccacttcttcatcgtgattctccggttgggatggatggcacgttcgtgccgtgaggtactgcatcggaatgccgcacgcggcccgtgcttcgcgcatgacggcgctgaagcaggagccaggcggcgggaatgacgaacatcgacagcagcggcgccgtgaccatgccgccgaccatcggcgcggcaatgcgctgcatcacttcggagccggcgccgtgcccgaccatgatcggcacgaggccggcgagcacgacggcgaccgtcatcgccttcggccgcacgcgcagcaccgcgccttcgcggatcgcgtcgagcagcagcgcgtcggtcagcggttcgccggcatcgagccggcgctgcagcgcgcccttcaggtacagcagcatgacgacgccgaattcggcggccacgcccgcgagcgcgatgaaacccaccgacgtcgcgacggacaccgcatggccgagcgcccacacgagccagaagccgccgaccagcgcgaacggcaccgtcgacatcagcagcagcgcatcggccgccgagccgaacgtgagaaacagcagcacgaagatcaccacgagcgtgaccggcacgacggtgcgcagcctggccgccgcgcgttcgagatactcgaactgccccgaccacgcgatcgaatagccgggcggcaatgcgacctgttgcgcgacggcctgctgcatcgcgcgcacggcgctctgcagatcggtgccgcggatgtcgacgtacacgtagccggacagtcgcgcgttctcgctgcggatcatcggcggcccgtcggcgatcgcgatgcgcgcgacgtcgccgaggcggatctgcgcgccgcgcgcggtgacgaccggcagctgccgcaggttctcgaccgaatcgcggatctcgcgcgggtagcggaggttgatcggaaagcgctcgcggcccgcgatcacttcgccgacatcgtcgccgccgaccgccgaagacacgaccgactggatgtcggccaccgacaatccgtagcgcgcggcggcaagccggtcgatatcgacgtcgatgtagcggccgccgttcagccgttccgcaagcgcggacgtcacgcccggcacgcgcttcaccgcggcctcgacctgcttcgcgatcgcgtcgatcccggccaggtccggcccggaaatcttcacgccgaccggcgtcttgataccggtggacagcatgtcgagccggttgcggatcggcggcacccacacgttcgacaggcccggcaccttcaccgtgcggtcgagttcgtcgacgagcttctccggcgtcatgccgggccgccatgcgctgcgcggcttgaaccggatcgtcgtttcgaacatctcgagcggcgcgggatcggtcgcggtatcggcgcggcccgacttgccgaacaccgtgtcgacctcgggcacggtcttgatcagccggtcggtctgctgcagcagctcgctcgccttgtcggcggaaaggcccggcagcgcggtcggcatgtacagcaggtcgccttcgtcgagcggcggcatgaattcgccgccgagccgcgacaacggtacggccgtcagtccgagcgcgacgaccgcgacgccgatcgcggcccacggccgccggagcgtcgcttcgagcagcggccggtacacgcggatcagcacgcggttgatcgggttcgcgtgctcgtgcggaatgcggccgcgcacgagataacccatcagcaccggcaccagcgtcaccgacagcccggcagcggcggcgatcgtgtaggtcttcgtgaacgccagcggcgcgaacagcttgccttcctgcccttccagcgaaaacaccgggatgaacgacaacgtgatgatcagcagcgagaagaacagcgcgggcccgacctccgcggccgacgtcgcgacgagctcccatcgtcgcgcggccgagaccggttcgccgggatgcgcgtggtcgtacgcctcgagatgcttgtgcgcgttctcgatcatcacgatcgccgcgtcgatcatcgcgccgatcgcgatcgcgatcccgccgagcgacatcaggttcgcgttgacgccctggtagcgcatcacgatgaacgcagccagcacgccgagcggcagcgacaggatcgcgacgaacgcgctgcgcagatggaacaggaacaccgcgcagacgatgccgacgatgacgaattcctcgatcagcttgtccttcaggttgcccaccgcgcgctcgatcagttgcgagcgatcgtaggtcgtgacgatctcgacgccgggcggcagcgaacgcttcaggtcggccagcttcgccttcaccgcgtcgatcgtcgtgagcgcattcttgcccgagcgcatcacgacgacgccgcccgtcacctcgccctgcccgttcagctccgcgatcccgcgccgcatcgcggggccgacctggatgcgcgcgacgtcgccgagcagcacgggcgtgccggcgtcgttcgtgcgcagcaccacgtgccggaaatcgtcgagcgtgcgcaggtagccggtcgagcgcaccatgtactccgactcggccagctcgacgaccgagccgccggacgcctggttcgcgttgccgagcgcagtcgcgatttccgcctgcgtgatgccgtacgcgcgcagcctgtccggatcgagcacgacctggtactgctgcaccatcccgccgatgctcgcgacttccgagacgtccggcacggccttcagctcgaacttcaggaaccagtcgttgagcgcgcgcagttgcccgggatcgtgacggccggtgcgatcgacgagcgcgtactcgtacacccagccgacgccggtcgcatccggcccgagcgacacggtcgcgccggccggcagccggctctgcacctggctcaggtattcgagcacgcgcgagcgcgcccagtacggatcggtgcggtcgtcgaacagcacgtagacgaacgcgtcaccgaacgacgagtacgcgcggacggttttcgcaccgggcacgccgagcagcgtggtcgtcaacggataggtcacctggtcctcgacgatctgcggcgccttgcccggatacgacgccttgacgatcacctgcgtgtccgacagatcgggcaacgcgtcgagcggcgtctgcccgacggagtggacgccccacgcggcgatcagcacggtggcgagcagcacgaggaagcggttgtggaccgaccagcgaatgatgcgcgcgatcatcgttcgcctccctgcggttcgaccttcgtcaggcgataaccgtcgtcggtctgcgtgaacgcgaaacgcaccgtctggcccggcttcacgccagggaacgcggcggccgacggcttgccgaacgtcatcgtcatcgcgccccagccgagcgccggcacgggttgatgcgagaacgtgatgtcgtctgccgtgacctgttcgaccttgcctgtggtttcgtagatcggggccgctgctttcggcgccggctcggcagtcaccgccgccccgcttgcgccggggtcgctccgcagccgcggcagcacgctcttcaggctcgcctccgaatcgatcaggaactgccccgatgcaacgaccgtatcgccttcgttcagcccgtcgagcacttccgtgtcgccgccgatgtcgttgccggtcgtcacctgcaccggctggagccggccgtcgccgttcttcacgatgacgatcgtgcgcttgccggtcgcgatcaccgcttcggacggcacgagcaggcgcgacacgctcgccttcccggcgacccgcacgcgcatcagcatgccgggcgtgagcttcagcgcggcgttgtcgatctccacgcgtgcctgcagcgtgcggctgctcgtgctgatgccgggcagcacttcgcggatgcgcccggtgaaacgccgcgccgggtcgcccgcgaacgtcgcatcgaccggcatccccggctgcacgttcagcgcgagcgcttccggcacctcgacgatgagccacagcgtcgacagccccgcaatcttcgccagcgtctgtccgggcgcgaccatcgcgccgtcccgcacgttcagctcgctgacgacgccggtttccggcgcgctcagcacgacgtgcgtctgcgcgcggccggtgcgatcgaggctcgcgatcatgccgtcgggaatcgacagcgcccgcatccgcgcgcgcgatgcatcgagcaggctgccgtccatcccgccgcgcttgagcgcgaggtattcctcctgcggcgcgagccagtcgggcacgaacagcgacgccaccggcgcgcccttcgcgatgcgctgcatcggtgcgcgtgcatacaggcgatcgatgtagccggtgacgcgcgactggacgacctccgcgcgcgattcgtcgaactgcgtggtgcccaccgcatcgaatccggccgccgtctgctgacggcgcacggtcgcataacggatgccgagattctgctgcaggcccggatcgatccggataccggacgcgccgccgccctcgtccgcatagacgggctgcaactgcatgtccatgaatggcgacttgcccggtttgtcgaaatgctggttcggcaccatcgggtcgtgccagtacagcaccttgcggcccgtgttcgggtcggtcttgccggcaggtccggcgccgggcgctacggacgatgcggacgatgcgccgcccgccgcatggcgcatgcctgcgacgtaaccggcgccgagcagcgccgcggcggcaaacgccaacagcaccgcgcgcgcgagggattgctttttcatgaggttctccttcactgcgcggcggccatcgtcgacggcacgacctgatattcgagctgcgcccaggtctgcgacacgtcgcgcctgagatcgagcacctgcaactgcgcgtcgagttgcgcgcgccgcgcggcgaacgtgtcggcgagtgaacccgtgcccgcccggtaggcggcatcggccagctgcacgcgctggtcggcggcgggcaacagcgacgtactcaggttcgcgatgcgttcgcggccgctcgcgagcgtttcggactgcgtgcggatatcggcctgcacctggcgcagcgtgtcctcgtacatcaggcgcgccttcgtcgccagttcggccttctcggcgacatcacggttctggcggttcctgcgattgagcggcaacggaatcgtgacgccgacggacaccatgttcgaatacgcgccgccgcgctgctggtacgcgacctcccacgtccagttcgggcggcgttcgctgttcgcgacggcggtatcggcttcggcgacggcgatatcgtcggcggccgtgatcagcgccggctgcgatacgcgcagttcgtccggcggcaacgacgacacgaacgattccggcgcgggcggcgtgcccgtgacgtccgacgccggcacggcggtccagcgcgacaacgcgatgagcgcggtctggtagacctgccgcgctttcagccattgatcctgcgtctgcgcgagcatggcccgcgcctggacgacatcggccgcactcgccttcgcgccgcgatacgacgccttcgtcgcgtcgagttcatggttcatgtgatcgagcaatgcctgctgcaacgcaagcgcctgcttcgcgtagacggcgttcagccacgccgttgcggtttgctggcgtacgctcgcgagctgcgcgagatagccggcgcgctcgcgcccgacctgctcgttggccagtgccgagcgcaggcgccgcttgtcgccggacacccactcctgctcgatgccgatgcggcgcatcgtcatgaagtcctggccgacggtgaagcgctggccgccattgaccggcaggttgtcaatgccggccttgagcatcgggtcgggcagttggccggccttcacggccgcctccgagctggcgcgcaccgaagcctgggcggcctgcatcgacgcggaatgatcggtggcggactgcagcgcggcgtccagcgtaaaggcggttgctgcgcgtgagccgcgcccgcaaccagcagcgccgcccaaagcatgggcgcgcgccggcgcgcacgccgcgcaagcggcgtgccgggatggaatgacatggtttaaccccaacggcggaaccccacggggattccacgtcctgcgcacaggacgaacctcaccgcgaatgcggcgaacctatcggatcgggatcagctgatgcgtggagggcgccacaacccgttcggatcgcggaccgggaggatttgcgcgtagtggaaggcaacgatgctggcgaacgcagcgggacgaccgacttcggcgcgagcggccggatgatagagactgccgaactggcattgcgccgtcagcttgcaggacaggcccttcgctttcgcgtgggccttgccggtggacgacgactgcatcgaatcgcagcccggcatgtcggcggacatgccggcgtccatgtccatgtccatcgacatgccctgctgcatcatcgggcattccccggccaggccgctggctgccagcccgctgatgggcagcaccgcgcagagcagcagcaggatgacggtccggaggaatttcatgcgggcgattatagcgcggggttttgcggtgtggcggcgcatcgatacggaggaacgacgcgccgtagccgcacccgccaccgcacgctaccgcgccaacgcgtcggcctccagcacggcgcgcaccgccggccgcgcacgcacccgctcgtaccatgcacgcagatgcgcataccgggtcaggtcgatatccgcgttgtacaccgaccgcatccattcggccttgccccagccggtcagcgcgaacaggtaggcatcggcaacggtgaacgtgtcgccggtcaggaatgccttgccgtcgagctggcggtcgatccatgcaaagcggctgtcgagcttcgttctcgccggatcgacgtatttcccggcctgcaccgcgtacagcagcggaatgaaccccttgtggatctcggtgccgagaaaattgagccattccatcagccggtagcgcgcgagcgtgccgtacgcaggcgcgagcgcggcttccgggcgcagatccgcgagatactgcgcgatcaccgggccttcgcgcagcagcgagccgtcgtcgagttcgagcagcggcacgtagccgagttcggtcacatcgtagtaattgcgcccgtcttcaatgacatgcttgcgtgcgtcgaccttgatgacctccgcgtcgatgccgccttcgcgcagcacgatgcagatggcctgcgaacagcttccgggagcgtgatagagcttcatgcgtttccttggtgggttgtccatgtatcgattcgccgcgacgcgggcgctaatatctcgcatcggcgcatcgccgggaagacggcagtcgtttgtgccgtagtcacaaaaatttaccgaccaggattcagcacgatgaaaacgagtgcgaccggatgttccgttgaagaagcgatgcgcctgctcggcggccgctggcggctgctgctggtgtcgtatctgctcgacgggccgcgacgcttcagcgacctgcgccgcgacatgcccggcatctcgcagcgcatgctgacgctcgacctgcgcgcactcgaagatgcagggctcgtgcggcgcaccgtctatccggaagtgccggtgcgggtcgagtacgacctgaccgccgacggcgaccggctgcggcccgtcgtcgaggtcatgcgcgaattcgggctgtggctgaaggcgcgcgatgccgctgcgtcgtgcgacaccggcgcgacgcccggcgcggcggcagcgatcggaacggtccttcattcgaaccgataacccctaccacccttacgcaggaacccgttcatggaacttcacgccaccgtcggcgcggcgacgtccgatctcgacgacgacgaaagcttcgccaacatctactgtcacgacgccgagcaggactattgcttcgcgttgtcgcgctttccggacgacacgctgatcgaagtgatggtgcgcgaccagatcacctggcgcgtcaaggatctgtcggtgaggctgacggacgacacgatcgacatcgagatcgaacccggcatcgccgcgcgactcgacggccagacgcgctacgtgatccatctcgcgcccggccagtacgatccggtcacgctgcgcgccgcgctgaaggagatcttcgcggggaagagcgggtttcaggacgacagcacgcgcggttaacggctcaaccgcaccgtcatcgtcgccttcgcgagggcctggtagtgagcggtataaccaacgaccgcaggcgtcgcgtcacgctcgaccggcagcttcgcgaccttgagcgcggtcagcgtaatgacgtagcgatgggtgtcgccctgcggcgggcatgggccaagatagccgacatggccggtgtcgttcttcatcgggacggcacccgccggcagtccggcaacgtcattgcccgaaccgggcgcgatgccatgcgccgacgccggtatgtcggcaacgacccagtgccagaagccggaacccgtcggcgcgtcggcatcgaacatcgtcagcaggtagctttgcgtgccctccggaacaccgctccaccgtatggagggcgaaatgttctgaccgtggcagccgaagctgtccgatacctgcgcgcgctcaaacgcgccgccggcaagctccgcgctttcgatcgagaaatcgcccgcccgtgccgtaccggcagcgagcatcgcaacgcaaagggcgaaaccgggcttgaatatcgtcatcgtcaacctcaccagcaagcaggaatggaacagagattcttgcaatcgcgccggccccgaacaaggcaagcaaacgtaccggtatggcgactacccggcaacgtccgccatgccggccccgctcgcggaaagcgccggatgccggtacattggcggcaaacggaagtcggggccggccgcttccatcctcattcacgccattcatgcccttcatgcccgatccaaccatgacgcgcctttcacgactccgttcgctgctccacggctccatgctgttcgttgcctgcgcatcgatcgcgcccgccgcgcaggcggccaaaccgctgctcacgttcaaggtcgacgacaccgtcacggcccgcgtcgaacgggcggacagcgagcacattaccgtgcgcttcctgccgagcggcaaaacgcagacgctcgacgtgaccgccgccgacgaggaaggccgctatcacctcgcgtcggacgactacaacttcgatggccaccgcgatctcgcgatgcacgcgacgctcggcatggtgaacgatggctacggcatctacctgtacgacgccgcgcgccagcagttcgagccgttgcggatgcccgcgagcgacatgccgcacggcaattgcgacgggctggtcaacgtccaggcgaagccgaaggagcgcacgctgtacagctcgtgccgcggcggcccgatctggtacaccgatgcgtatcgcttcgacggcagcggcaggatgtacctgtaccagtcgagcgaagcgataccggatgacctgcgcgacctgctcgacaccgacaacggcccgtcgtcgatgctgttgacctacgacgcgcaaggcaagcgtgtcgcgcgccgccccgacgcctatggcggcggcaccgtcacgttcaaggtgcggccggctcgcctgccgctgcacgatgcgatgaccgatgcgcccacgcgccgctatgtcgtcgcgggcgacacggtggaggtgatcgacgcgagcgccgatttccagtggctgaaggtgcggtatcgcaacccgcatgcaggggcggcgcagggctgggtcagtgcgaaggaggcgatgggcaactgattcaagcggcggcctattcgccacgccttcccacatattgaacgcagaacatcccattaatagggatacctgcccaaatgttgacgcgcttcccgccgcggctctaacgttcgccccaacgccattcgattcggtcgccccgctcgcgggcgacggccgggcacagaacacaggagacaaccgtggcccaatccgcgtcgcgtacccactcgaacccgccggatcaattgcccgcccacgccggcatcgcatccgattcaaccgcccgcgcggccgccgcgcaggcagcaccacccagccgcaagcgcctgctgatcctcgcgctgctgttcgtcacggtcgtgatcaactatctcgaccgcagcaacctgtcgatcgccgcgcccgcgctgttcaaggaactgaacatcgatcccgtgcgcgcgggcctcgtgttttccgcgttcggctggacctatgcgctgatgcaagtacctggcggctggctcgtcgacaaggtgtcgccgcgcgtactgtatgccggcgcgctcgcgctgtggtcggccgcgacgttgctgctcggcttcgccggttcgttcgtcgggctggtcgtgctgcgtctcgcggtgggtgcgctcgaagcgccggcctacccgatcaacaaccgcgtggtgacgacgtggttcccaacccgcgagcgcgcgagcgcgatcggcggctacacgtcgggccagttcgtcggcctcgcgttcctcacgccggtgctcgcgtggctgcaggtgcatctgggctggcacatggtgttcgtcgcgaccggcctcgccggcatcgcatgggccgcgatctggtatgcggtgtatcgcgagccgcgcgcgtttcgcggcgtcaacgcggccgagatcgcgctgatccgcgacggcggcggcctcgtcgatctcgaagaccgcatcgcggcgcgcaccgaacgcgcaccgtcgacgtggcgcgacctcggcgtcgtgctcggccggcgcaagctgtggggcatctatctcggccagttcgcgctgaactcgacgctgtggttcttcctcacgtggttcccgacctacctcgtcaagtaccgcggaatggacttcatcaagtcgggctttctcgcgtcgctgccgttcctcgccgcgttcgtcggcgtgctgtgctcgggcgtgctgtcggactggctgatgcgtcgcggcgcgtcacagggcttcgcgcgcaagctgccgatcatctcggggctgctgatctcgacctgcatcatcggcgcgaactacgtcacgtcgaccggctgggtgatcgcgttcatgacgatcgcgttcttcggcaacggcttcgcgtcgatcacgtggtcgctcgtgtcggggctcgcgcccgcgcggctgatcggcctcacgggcggcgtgttcaacctgatcggcaacctgtccgcgatcgcgacgccgatcgtgatcgggctgctcgtgaacggcgcggatttctcgcgcgcgatcacctacatcgccgcgatggcactcgcgggcagcctgtcgtatggcttgctcgtcggcaaggtcgaacgcatcgacgcatgagcctcacgacggcggcacacgcgtgccgccctgccttgccgccgcccgcgtgccgcatcagaaccgctgaaacccgtcgcgcgcgagatcgtgcggattgcccgccacgtagtcgagtgcgcacgcgtcggtatcgatgccgacggtcagcagcgtctcccagcgctcggtgtcgggcatcgacggatcggcgtggaagcacacgacggcctgatcgcccgccgcaccacacattgccgccgcgcgctcgcgcacatcggcgctcgtcatcccgttcacgacttcgttcaggtgcgcgaagcgttcgcgcgtggtcgagctgtcgggcatgcactcgccgccgctcagcgcgcgatcgaggaagtggttcgtatgcagcagccagccgtccgggcgcggcaccaccacaccgatgcccgacgggctcagctcgatgctcgccgcgcgcgggttcgcgtcatgccgcgtgaacacggtcagcaccgtggacgcgctcacgcgtgcggaccgtgcgagctcgatcgcctcctgcaccgtcgtcgcatcctcgagcaggcgccgcgcgatcgcgtgcacgggcacaccggcgctgccgttgtcgctcgcgtgatgcaggatgttgaagtgcagccccagccccgcgctgttcacgccgagcttcgcgagcatcccgaactcggagaacagcttgacggtgcggccgtgcggcgtcgcgaaccgcatcaacagcccctgcggcgcgaggctgtcgtgccagtcccacgtctgcagcgtgcgcggcgcgtgcgggccggccggcgcgtagacggtcgtcgagcactcgccttcggccgacgcgggcgcggtcgcgagaatctcggtgcgcgcgttcaggcacgcgagctgccagcgcggcaggtcgacgccgtcggcgatcgcgtcgacttcggcggccaggcgcgggcaccacgcaccgagcgcggccaggctcgcttcgccgatctcccgcgcgcgctgcggctcgatgccgagcttcgggaagaacgcgaggtaaagcgcgaccgtctcgcgaatctcggcggcgaaacgcgcgccgatcaggcggccgcgctcgtgcggattggtgaggtcggtcacgaaggtgtgcagcttcaaggtcaaatctcctgggttgaatgcgtgccgggcccgcacggcccggaacgtgatgcatggcgcagccggtcggccggcatttgcaccggccggaatggcgagaccagtcagaacggtcagaacgaatagatgaactgcatcccggccaggtcgttgctgcgcgcgtacgtgccgttgctcttcaggaacaccggatggttcgccgcgtcgtggcgatactcgagcttcacggtgatctgctgcgtcggatagaacagcaggtcggccgtgatcgcgtaacgctgcgcgcccttgcactcggtgccgttcgtcgacgaaccctggaagcacgccggatcgatgccgaagccgctcgacccgttcaccgacggattgccgcccgcgagcccgtactggatgttcgtgccgccgccgccgttcgacgtgttgttcaggtagtcgaagcgcagcgtcgcgcccatgcggccgacccatgcctgcgtccacttcgtatggccgagcagcgacatcccgtaccagcgtgcggtgccgccgttccacgcgcccttctgcagctcgccgtagtcgacctgcgcgttgacctgcgtcttgtcgtgcgtataggtcacgtcggcttccacgtacttgtagaggccggtcggcgacgagccgttgcactggtagccgtacccgcccgccgtcgcgcacggcgagaacagcgactgccggcccagcatcccggaaatgccgaagtcgaaggcggtcgacgtcgcgttgtcgaagcgcgcggtgatcgtcggcgtccagttggtcttggtcgtgttgttcgccgcgttcgcgatcgcgccggcggtgcgcagcacctcgttgccgatcacgacctgccagaagcgcgtcatcgccgcgttggagcccttcaagccgacgccgatcaggttgcccggttcgctgaagtcgtacagcagcccgtgcgtgagcgtcagcatctgggtcgacggctgcacttcgtagccggcgaggctcggcatcatcccgatctcgaaagtgcgcgtcgtgctgagcggcacggtcaccacggcctgcgtgacgatgttgttgccgacgccgccgtgcgaattgctgaacacgttgccgaagccgcggttcggctggatcacgacctccgccgacggcgccatcgggccgacgccgaaggtcttcttgatgtcgaggtagacgtcgccgatcgtgctgttgaagtagtcgtacgcgcccggatcgtggttcaggaactggaacccggacgtgcgctgtgcgcggttgaacaggtacacgggatcgacgtagccggtgatgctcaggcccgcgagcgggccggtcgtcgcggcttcctgcagcgagtcgaccttcagcgatgcgttcgcgatctgctcgcgcatctgctgcaggtcgtcgttcgtgaacgccggtgcggaatcggcggccggcgcggcggcggcggccgtgttgatcgaaccgatccttgcgccgctcgatgttgcggtggctgcggtggcggccgtcgccgcgccgggcgcctgcgcggccagcatgctcgcgcgcagcgcgttcacctgctgctgcagcgcggtgacctgcgcctgcagcgccttcatcctgctcgcgtcggtcgcctgcggcgtgtgcgcgaatgccgtggccgcgtcgaacgcgagcaggcacagcgccgtcatgtgtttgagtttcatgttctgggtggtcgtcgggacgagcgcgcccccgcccgccgcgatcagcggcggggcgcgcaggtgtgcgggaagcgggaagcggcggccggcttactcggtcttcagcttcgtccagaggcggttctgcagacgcatcagctcaggcggaaccggcttgctgaggctcagcttgcggatcacgtcggcgggcgggaacacggccggatcgctcgtcacttcggcccgcacgaggcgcttcgacgacggcacggccgacgggtacgacgtgtcgttggtcaggttcgcgctctccttctccgacagcacgaagttgacgaacttcagcgcggcgtccgggtgcggtgcatccttcggcacggccatcatgtcgaaccacatcgcgctgccctcggtcgggatcacgtacttgatgtgatagggcttcttcgcggcagcggccgcgatccgcgcggagttcacgtcgcccgaccagccgagcgcgaggcagatgtcgccgcccgcgagatcgttgatatagctgctcgaattgaactgcgtgatgtacggacgcaccgacttcagcagctcgtatgcggcctggtagtcggccgggttcgtcgtgttcgggtctttcttcaggtagacgaacgccatcccgaacgcatcgaccggcgaatcgagcaccgacacgccgcagtgcttcagcttctgcgcatacttcggatcgaacagcagcgcccagctgtcgagcggcgcgtcgttgccgagcgcggccttcaccttctcgacgttcatcccgagcccgtcggtgccccaggtccacggaatgccgtactggttgcccggatcgtccttcgcgagcgccttcaggatttccggatcgagcagcccgtagttcggcacctggctcttgtcgatcttgcggaagatgccggcctgcagctgccgcgcccagaagatgtcggacggcacgacgacgtcgtaacccgacgtgcccgacagcagcttcgcctgcaacgtctcgttcgaatcgaactcctggtagacgaccttgatgccggtcgccttctcgaagttcgcgatcgtcgccttgccgatcgagttgccccagttgtacacgttgacgacgtccgccgcgtgcgcaaccggcgcgccggcccacagcccgccgcccagcgcgagcgccgcgcatgccgttcccagatgcctgctccaatcccctgccatggtttcctccgtcgatatcatgatccgctcgcaatgaacggtgtgtgcttcggtccggaaaaatgtagccagaggaaattggccggtctgccctgccaataggggacacgccgcacaatcggcgcatccggttccggccggatgcgccgagccgcgaaaacgaaagcatcccgaaagattccgtcgccgcttcgtcagccgggatgcccgttcaggacgcctgcacacccgtgcgcgcgccgaaatcgtcgcccacgtgcgtgatgcggccgcccatcatcgtcagcccgacgtcgatgcggccgatgtcgtactggccgacctcgaacaggtcgttctcgagcacgacgagatccgcgcgcttgccgggcgtcagcgagccgacctcgtgctccatcccgagctggtacgcgccgtggatcgtgtacgcggcgatcagttgcggaatgctcaggcgctcggcgatgtccgggaacaccggcgcatcgggctcgcccgcgagctggcgcgtatggcccgactcgatgtgttcgagcggcttgtgctggcagcggcactggcaagcgaggccgtccatgccgatcgacaccgtcacgccttcgtcgaggaacgtgcggaacttgtacatgctgctccagcgctcgtggccgtagtggtcgcgcaactgctcggtgtacgcgtcgaccacgccccattgcagctgcgtgttcgccatcacgcccgcgcggcggaagcgcgggatgtcgtccggatgcgtgaggaacgcgtgcgtgatcacgtggcggcggtcgcgcggcgggttcgtgcggttcaccgcgtcgaagccgtcgagcgccatccgcacggccgcgtcgccgacgcaatggaccatcacgttcgcattcgcgcgatcggcctcgaccagatagcggttgaacgtgtcggccggcatcgtcggcgcgccgcaggtgtccgggcggtccgcgtacggttcgagcaggtacgcggtgtggttcgcctcggtgccgtcgaggaacagcttcaatgcgcgcgccttcacgagcggcgaatcgtactgctcgcgataccggacgagcgtgccgaccgggtcgtcgatctcgccgatcaccgcgacgctgccgaccacccgcagcttcaggtcgcccgcgcgctccatcgtctgcagcgtctcgtacagcagcgactggtcgccgctcgcgtcgaagaagcccgcgtcgaacacggtcgtcacgccggccgcgcacagcttcttctgccacggcgggatcgatttcaggtacaggtcgatgccggtcggcagcaggccggccgcgctgatccgctgcatcagcaacgaatacgcggcgccgtcgacgatcaggccggtcggctcgccggtcaccgcgtccttctcgaaccagctcgcgccttcctgcacgggcggcgtcgatgcgtcgatgccggcgatctccagcgccttcgagttcacccacatcgtatggaaatcggtcgacagcaggcacacggggcgatccgcgcagatcgcgtcgagcgtctccttgcgcagcagcgccggcggaatcgtcgcctgcacccagcccatcccggtgatcgccggctcgttcggatgcgattcgacgtacgcgcgcagcgcgccgagcaccttctgcggatcctcgtcgttcacgaacgcctggaacgcgaacgcggtcgtctcgaagtgccagtgcgattcgacgaagcccggcagcacgagccggccggcagcgtcgacgaccttcgtccgcgcgccgacgtacgcctgcacggccgccgtgtcgccgacatggacgatccggccgtcgcgcacggcgacagcctgcgcccagggcttgtgcggatcgacggtatagaccttcgcgttggtcagaacgaaatccgccggcgtcgtggcggcgtgcgtcggttgcatctgcatggcctgtcctttctggtcatcaggttttcgaagtgctttcactataggcagacgattcgcgccggtatgcccccgtcgccggggcttccgcgaattccggccgccgtgcgttcggtcttgtcgtcgttttggggacaacgcacgaaatccgtggggtgatccggtgaattcccggctgacgcgtgcacggcgttcgcgtaacgtcgcgctgtcccctgaccgccttcgtccgaccatgcgacttctccagcccgaccctgccgctcgcggccactacctgatcggcgtgcgtcccgactcactcggcgcgacgctgcgcgcggtcggcacgccggatttcgtcggcgcggtcacggagttcgtcaacgacagcatcgacgccgacgccgtgcacctcgagcgctggcgcgccgatacgggcagcacgtcgggtttcgtcgtcgaatggctcggcagcggcagcctgcgcttcgcggccgatacgctgcgcgtgatggatatctactaccaggactactgccaggccgatccgctggtcgcgccgctgcgcggcaaacccggcacgctgctcgtgcagcgccatgtcgacggcatcgcgcagggcgagttccgccgccggatcttcgacgagcccggcatcgggcaggaatgcctgctcgtgcacggcaacgcgcacctgcaatacgcgctcgggctcgcgcgcacggtcgggcgcgccgcgttcaccacggacgagctgtttcacttccggcagatggtcgacctgctgttcccgatgttcgagctgcatgcgcgcacctgtgcggcgcggcgcgtggcggcggtgtcggtgaatgccgcgtcgcaggcgggtttcgatgcgcggctcgaacggcaggacgtgcagctgtcgcgccgcgagcacgagatctgccggctgatgctgtgcgggcgctcggtgcccgaggccgcgcagcagctcgacgtgaagctgtcgacggccgagtcgtacgtgaagcgcgcgttcgcgaagctcggcgtacgcacgcgccgcgagctgttcgactgggtactcgtcgactgctgaacgcgcggcctggatttacgcggccagcgcggccgccttgatgttgaaggcgcgcagcaggtcctcgcagaacgcgtcgacgatcggcttgtcgctcgtgctgcgcttcatcgcgagatgcagcggcacgtcgaaactgaacgtcgcgcggccgacggccttcacgagcccgcgctgctcgaacggctccgcgtagtgcgcgggcaggtagccgagatggccgcccgacaggatcaggatcgtcgcggcctcgatgctgtccgcgctcgcggtcacgcgccgctcgggcagcggatactgctcctccggcaccggataggtgcgccacacccagtcatgctgttgcagatcgtccgccgtcacgggccgcgacgcatggaacagcggatgcccgcgcccgcagtagatcacctgctgctcggtgaacagcggcgtgtagagcagcccgggcacgcgatgccagaaatacccgatcgcgagatcgagctggttgttgacgaggctttcctcgagttcctgcggcgacgcgaccttcatcgcgaacgtgacggcctggtcgcgcttgcggaatgcgccgatcgcatcggccacgcgcgcgttctcgacgagcggcgcctggccgatcaggccgatcgacaacgtgccgaccagcttgcggtcgatgtcgcgcacgcgcgcgacgaattcggaggtcgccgcgacgagcgtgcgcgcggtggccgcgaagcgttcgcccttcgacgtcaggcgaaagccgccgcgcccgcgatcgcagagcttgaagccgacgcgcgcttcgagcgccgacagttgcgtgctgatggtcgactgccgcacgccgagcgacgcctcggcggccgtgatgccgcgtgcgtcgacgacggccagaaagacccggatgagccggagatcgagatcggaagtattcgagaacatgcctgaagccgctgcgcgtgtgcgcgttgcccggccggcacgacgcgcatcgcgcgccacgcccgccgccttcgccgatgaaccggaccggacgcgcgccgccatcggcagcggcgcgcgtcgaaaccgtcattcaggtgccaccgcgagcgcgcgttccatgccgaacacggccggccgcagccgccggtagcacaggaacgccaccgcgcacagcacgatcgccgcgatcagcgccgactgcgtgcctgcgcgctcgatcagcgagccgcccgcgaccgagccgacgccgtagccgagcgcgacgcagcccggcgacagcgcggccgacttgccgaccaggtcgtactgcggaatcgtcgcgtagatcagcagcgcgccgccggtccagcagccgatgaacacgaccgcgccgagcgtgaacgtcatggccgatgccggcatcgcgagcagcacggccgcgaccgcgcagccgccgaggttgacgagcgcccagcggcgcaggcccgcgcccgcgccgagcttcggcatcgccgcgcagatcacgaggctcgcgatgttcgcgatgccgagcacgagcgacaccgacctgccgctcaggcccgccgcggtgccgatcttctcgaggaaggtccacacgacgccgacgccgccgtacagcgcgagctgcgcgcacagcacgagcatcgcgccccggcggtcgatgcggccgccgacgccggccggtgccggagcggccagcgtctcgccccggcgaaacagcggcgtcgcgagcacgaatacgccgagcacgcatgcgacgaaaccgaacacgccgtgcgcgccccatgcgtcgctcagcatcgggaagatgtaggccagcagcaccatgctccacgtcacctgccccatcagcatgatcccgagattgcgttccggcgcgcgcgagtacgacaggtagcgcagcgcgatcccgttcagcccgcccgagccgacgcccgcgatgaactgcaacgcggaatacgcgacgagcccgtgcgtcgcgagcgtgccgaggttcgcgccggccgcgagcgtcaccgcgcccgcgagcacccaccgcaccggctggcggccgagcacgaacgcgacgagcagcgtgcccgtcgattcgccgagcacctcgatgaagctcgacagcccgagcgccgcttcgccgaagccccaatggcgttcgacctgcccgacgatcgcgggcaggccgaggaagaccgtcggcccgaggatgccgagcagcagcatcacgacgacgaaccgcgcgctttcctgtcgcgcttcgtcctgcaggttcactacgttcattcggtgtctctctccgtgtccgcggcgcggaccgtctcctcgaggagtcgggtatggcggcggcccggcccgggccgccgtgtcgcttacatcgggaagcccatcgccttgatgccgctgatccacgcgcgcttccagccgccttccgcatccgcgccgtcgaacgcatggaacgtgatcttcgcggcgacccagcgcatcggctcgggcgggatgtagctcgggctctggttcgcgatgtcgagcttgcgctcggggctgtcgcgatcgaacaggatgttcagccccatgaacgcgccgaaccggctcgccgcgacgccgaaacccgtatagccggcgacgaacacggccttgtcgccgagatagcgcttcgcgaacaccgagccgcgcgagcagtagtcgatcggcccgccccacgcatgcgagaagcgcacgtcgctcaattgcgggaaggtgcggtagaacgcttccgcgagccggtaataggtctcgcgccggccgtcctgatgcggttccggatcgccgtcgaagtgatagctcaccaggccgccgaagatgatgttgttgttcttcgtcaggcggaaatagttgagctgcgtgcgcgtgtcgtacacgccctggcgattcttccagccgatccgcgcgagctgttcgtcggtgagcggctcggtggcgagcacgtggtcgcgcacctgcatcacccggcggttgatgtcgggaatcccgaccttcgcggtgccgctgccgaacacgacgcgcggcgcgcgcacgctgcccttcggcgtcttcacgaacacggtgctgccctcatcggtcacggtcacgagcggcgtgtgctcgtacagcttcacgccgagcgacagcgccgcacgcttcagcccccacgcgagcttcgccggatgcacgatgccgctgcggttacgcgaccacagcgcgcccgcgaacagcggtgaattcagttgttcgagtgtttcgtcgcggttcagcagcacgacgttgtggccgtactcgcgatgcaggtcgtaatcgcccttcaggtgcgcgatatgctcgggatcgaccgcgaccgtcatctcgccgttccattcgatgtcggcgtcgatgtcgtagcgcttcagcgtttcctcgaagccgtcgaggttgtgatggccgaacgcctcgagctgcgcgatgtcgttcgggaacacgcgcactgcattcggcagcccgtgcatcaccgacgtcgagatgatcccgcccgcgcggcccgatgcgccgtgcgcgaccttgccggcctcgatcagcaccacgttcaggtgcggcatctgttccttcgcctgcacggccgaccacagcccggtgaagccgccgccgacgatcagcaggtcggcgctcacgtcgccgacgagttccggctcggtggccggcgcggccgggttgtcgagccagtacgggaacagcttcgtattcgcgagcgccgcctcgacgcccaatgcgaccggcgcgccacgcaatgcgtgcgcctgcgccggcgcagtctctcttgccttgacttccatttccatgatccctgccatcacacgcggaaacgaaaccgccgccgggcgcgcgtcacacggacgacgacaccacggcggcggcttcggccatcacgacttctcgagcagcacgtagaacttcttcgcgtcctcgatcgtctcccagcggcccgcgaagccggccggcagcaggtagccctggcccggcgtgaattccttgcggttgccttcgacgtcggtcagcgcgatccggccctcgacgagccacaccgcttcgtcggccgcggtttccggaaactccaccgagccgaccttgccttcccaccagccgatgaggtagttgccgctcttgccttccgccgcgcgccagtcgctttcgtccatcccgaagtcgagcttcgtgaattcgccgatgcctgcgccgagcggcaggatgtccttgatcagtttggtcatcagaatctttcgtctcttgattgaaaaagcagagacaaagttactcatttacactgccccggtatgccccctccggggacaagcggtgttttccggggccggtcaggtcgcaaggacacctgccgggatttccctaatgacgttttgcgtggccgacgctacaatccgccggcttttcaccgggaaccgcatgctgctcaacgtgaaccccttccaccgcgacaacgaccgcttcaacgtgtcgttcaaggcgctgggcgagctgatcgagacggtcggcacgccgcacttcgtgccgcgcctcacgcaactgctcaatgaagtggtgccgctcgacgtcgcgcacgtcgaacgctcgcgcgtcgacggctcgatgcccaccggctaccgatgcgaatggatcggcagcagcggcatcggcgcggcgagcgccgacgtctccgacgtgatgacgctctactacgagcgttttctcgacagcgacccgctgttcgcggggctgcgcggcaagacgggcacgatgctcgtcgtgcgcgacatcgcggcgatcccgcccggcgaattccgccagcggctgttcgacgacgtgcagatcggccacgaatgcgtgctcgcacgcggcacgcgttattcgcagcattcgatcgcgctggagcgcggccgcgaccggccgccgttcacgctcgccgaaatgaaccgctttcgcagcatcagcgacgtgctgttcccgctgctcgaactgcacgcgtcgaccacggccgcgcggcgcattgcgcacccgacgcccgaagtccacccgctcgcgcagttcgacgcgcgcctcgcggccgacggcgtgaagctgtcgaagcgcgaatacgaaacctgcaagcacctgctttccggcaagaccgtgccggaaacggcggagatcctcggcgtgcgcgttgcgtcggccgagtcgtacgtgaagcgcgcgttcgcgaagctcggcgtgcgcacgaagcgcgaactcgccgcatggggttcggcgaccaccgcgttcccttccgccggcccgcacgacggcgccgcgccgccggccctctcgcgccgacctgatccgacctgatccggcctgacctggccccgcgcggccgcgttcggttgcgccgcgtcgatgcggcggcgccgcgcatcgagccccgtcgatgtaaacgttgcgacttcaaaatcttcgcgcgggcgttctcctctaccatcggccgatcgctttacctcagataaaggagacggccccatgccccgcgaactcaatcaaccgatgggcggcaacgagatgccgcgcttcggcggcatcgccacgatgatgcgcctgccgcaagccgagacgaccgacggcctcgacgtgtgcttcgtcggcgtgccgctcgacctcggcacgtcgaaccgctcgggctcgcgcttcggcccgcgccagatccgcaccgaatccgtgctgctgcgccgtacaacatggccacccgcgccgcaccgttcgattcgctgcaggtggccgacatcggcgacgtcgcgaccaacccgtacgacctgaaggactcggtgcgccgcatcgaagaggcatacgacgagatcgtcgcgaacggctgccggccgatcacgctcggcggcgatcacacgatcgcgtggccgatcctgcgcgcgctgcacaagaagtacggcaaggtcgccgtcgtccacgtcgacgcgcacgcggacgtgaacgacacgatgttcggcgagaagatcgcgcacggcacgccgttccgccgcgcggtggaggacgggctgctgcaatgcgacaaggtcacgcagatcggcctgcgcggtaccggctaccacgcggacgatttcgactggtgccgccagcagggcttcaccgtcgtgcaggcggaggaatgctggaacaagtcgctcgcgccgctgatggcgcaggtgcgcgaacgcgtcggcgacacgccggtgtatctcagcttcgacatcgacggcctcgacccgtcgttcgcgcccggcaccggcacgccggaaatcggcggcctcaccgtgcagcagggcctggaaatcatccgcggcatgaagggcctgaacatcgtcggcgcggatctcgtcgaagtcgcgccgccgtacgatccgaccggcaccaccgcgctcaccggcgcgaacctcgcgttcgagatgctctgcgtgatgccgggcgtcgcctaccgctaacccgaccgacctcgacaggatgaacctcatgtctaccgccgagctttccccttccgccgccacgttcgtgctgcccgccgcgcgcatcgccgggcagtccgtgcacacgcattccgacaaggccggcgcgccgatcttcaacgcgtcgaccggcgacgcgatcggctggcaggaattcgcgacggccgcgcacgtcgacgccgcggtgcgtgccgcgcgcgacgcattcgccggctggcgcgacacgccgccggccgaacgcggccggatgctcgcgacgatcgccgaacgcgtcgaggcatcgcgcgaccgcctgtcggcgctgcagatgcaggtgagcggcaagccgccgttcgaggccgaggccgatgtcggcgacgtcgccgccacgtttgcgtactacgcgaagctgtgcgaagacccggcactgttcgcggccgaaccggtcgcgctgccgagcgacgccgtcacggccgaacgctttacgacgcggtcggcgtcgcggcgctcgtcatgccgtggaacttcccgatggtcacgaccgcgtggaagctcgcgcccgcgctcgcggccggctgcgcggtcgtgctgaagccgtccgaactcacgtcgccgaccgagcacgcgctgctcgagatcgtcgagcaagcggggttgccggccggcgtcgtcaacgtcgtgaacggcggcgccgaggtcggcgcggcgctgaccgcgcatccgctgatcgacaagatttcgtttaccggcagcacggcggccggccgcaaggtcatgcaggccgcggccgtcgacatgaagcgcgtgacgctcgaactcggcggcaagtcgtcgctgatcgtgcgcgacgacgccgacctcgacgtcgcggtgtcgctcgcggttgcgggcgcgttcacgaacgcgggccagatgtgctcggccaccgcgcgcatcctcgtgcacgacagcgtgtaccgcagcttcatggccgcgttcgagacggccgtgcgtgcgctcgtcgtcgcgccgcccgccgcggaacaggtcgcgatggggccgctgatctcggccgcgcagctcgcgcgtcgaagcgatgctccagcacggcatcgaggcgggcgcacgcgtcgccttcagcggccgggtgacggatgccggcggtgcgggcttcttcatggcgcccgtcgtgatcgccgagccggccgccgacaacccgctgtggaccgacgaagtgttcggccccgtcgcgtgcgtgaaatcgttccgcaccgacgacgaagcgattgcgctcgcgaacgacacgcgctacgggctcgtcgcgaccgtcgtgacgcgcgatgccggtatcgcgaagcagttccaacagcgcgtgcgcgcggggctcgtgtggatcaacgcaccgcagctgatctatccgcacgtgtgctggggcgggttcgggctcagcggaatcggccgcgaactcggcgtcgcggggctgcgcagctatcaggaactgcgccacgcgatgcgcgatcgactgaccagtgcggccgttcaggccgttggcggcaccgtgtctcgtgcacggtgccgctttggttcttcggggattttcgggagagcgccggggtgttcggcatgcgccgatcatgagatttcacggcacgtgagcaaccctcaatgcgacagctcggcggcatggtcgtgctcgcgaagctggcccggaatcccgcactgcgcgagcccgcccgcgtcgatccacgcacgcgtgcgttccgcggccttgtcgatcagctgcgcacactgcgagtaatcgtatgacgacacgtcgagcggacagagcggcggcacgacatggatttgcgcgcgtgccccgtacaactccagatcgcgcaccagttgccgcgcgatcacgagcgtcagcgcgtgcgtcgcatgcgcgatcgcgctgcgcggcggtacgcgcaacgcgcacgcgaacccggccggcagcacgacgatccgcttgacgccgagcgcgatcgcgacggagatcggcgtattgttcgcgacgccgccgtcgacgagttccacgccgccgatgctgaccgacggaaacacgccgggaatcgccgcgctggcctgcacggcatccacgaccgggccggcggacagcacgacttcctggccgttcagcacgtcggtcgcgacgatgtggagcggcaacgcggcctgctcgatccgccggtacggcaggttcctttccagcagcaggcgcagcgcatcggcctcgaccagatgcggccggttgcgcagcagcatcgcgacgaggctgcgcatcgagaacggcatgatgtcctggcggcggatccggcaccacagcgcggcgagcatcgcgacgccgtccgcatcgggccggccggcgaaataggcagcgttgatcgcgcccgccgacgcgccgacgacgcaatcgggccgttcgccgctcgcgaccagctcgcggagcatgccgacctcgatcgcgccgagactgccgccgccggcgaacacgaaggcggtcgaggaagtgggatcggacgtcacggtgcgccctcctgcggttggctgcgacggtgctttctccatgatggatcgtgcggcgccccggatgtcttgatgaaaaccctgccggcgcgcgaacccggctggcgatgcgccgcgttcccggcattccgcgcgaagtcttccatggcgatgggtgtgtcattcgccgccgtgtttcccggccacatccatacggaaattcacgcgaaggcgcgcaattttgacttcgatcaagaaaatcgcgcataccgccgcccgcaaacgtatgccgcgcgtgaatcgcgcgcgctacgtggaatcacgggttcagtcgccccggcgaccgccgttattgcatcaacacccaccgaccggcatcgcgttgcgatacatcgggacggccgccggaatcgcattcgacacgcaacgatccggcgccgtcgcgggcatggagcaggatggccggacgtcccgcccgcttttcgacaacagatgcggcagcgcgagtcgcgcaagaggtaatcatgtttgtagccatcgggtggatcgtcgtgatcggatcggtgatcggcagttttgtcggcgtgggcggccatttgccggccttgctgcaaccgttcgaactgctgtgcattttcggcgccgcgctgggtgcgttcgtcgtcagcaatccggtcgcgacgctgaagaagacgatcaagagcctgccgacctgtttcaagggcggcggctatacgaaacagcagtacgtcgaactgatcgcgctgctgtacgagctgctgcagaaggcgcgcaaggacggcatgatggcgctcgaggccgacgtcgacgccccgaacaaagcccgctgttccagaagtattcgcacgtgctcgaagaccatcacctgctcgacttcatcgtcgattatctgcggatgatgtcgggcggcaacgtgaacgcgctggagatgcaggacctgatggacgaagaactgcatacgcaccatgcggaggcgtccgtcgcggccaacgcgatccagaagatggcggacggcctgccagcgttcggcatcgtcgcggcggtgatgggtgtcgtgcatacgatgggctcggtcggcgcgccgcccgccgtgctcggcaagatgatcgccggcgcgctcgtcggcaccttcctcggcatcctgctcgcgtacggcttcgtcggcccgctcgcggatctgctcaatgcgaagggccgcgccgcgcaagccgttccagtgcgtgaaggccgtgctgctcgcgtcgatgagcggctacgcgccggcggtggcggtggagttcggccgcaaggtgctgttcacggccgatcgcccgagcttcaaggagctcgacgaggccgtccgcgcgacgaagtcgcccaggcccgcataacggaggcgccatggccgaccatcgctccaacccgtcgaaacagtccgcatcggcaccgctcgtcgtcgtgcgccgcaagaagggcgaggaccacgacgcccaccacggcggcgcctggaaaatcgcctacgccgatttcgtcacggcgatgatggcgttcttcctgctgatgtggctgctcggctcggtgtccaagtacgacaagcaggggatcgaggattacttcaacacgccgctgtcgacgctcctgtccggcgggaaagacgcacaggcgccgcgcccgagcatcgtgcagggtggcggccgcgacctgtcggatccggcgcccgccatcgacgcgaaagcgcaaccggtgccggccagttcgcccgcggccgctgccgacatcgtcgatacgcaaagctcgagcgcctgaaggcgaagctgaccgcggcgattgcacaaagcccgtcattgcgcgcgtaccaggaccagatccggatcgcgatcactcacgagggcttgcgcatcgagatcgtcgattcgctcaagcgcccgatgttcgcgtcgggcagttcgcaacccgaagggtatgccaccgcgatcctcacccagatcggcacggcactcgacgatgtcgacaaccgcgtgtcgattgccggccataccgattcgacgccgtatcgcgacggccccacgggttattcgaactgggagctctccagcgatcgcgcgaacgccgcgcggcgcgcgctggtcgcgggtggattgcgggaagaaaagctgctccaggtgcgcgggctcgcggatgtcctgccgctcgaccggaacgtcgcggacgagccgaccaatcgccgcatcagcatcctcgtgatgaacaatgccgccgagcaggcgttctttcgggacggcggcaggacgacggtggacgaatcggccggcgcccgggccgccgtgctgccggcggcgctcacgcggccgcattaggcgcgggcgtattcacaaacgcggggcggatgtgcccgatggggccgggcgctgcgcgcagcccttgtgcgacagcgtggtcctcggcttcgcggtcgcgttcggaacggtcgggcgcgacatcgactgactcgggcggttgttggggcggttgttggggcggttgttgcggccgttgctcgggccgttgctcgggccgttgcgaaggccattgcgagggccgttaccagggccgctgacggcaccatgtctcgtgcacggtgccgtttttcgcgcactcgatatgttccgtagaatatatcgcaaccagcacttccggagattcgccatgccccgcacgccgacggatcgcgccccgcagcgcaccgcacgggaacagccgctcgcgcacaagatcagtgcgctcaggccgctgtcgagcgacgcgcgcgcagcaggtcacggatgtcgtcgacgcgttccggcgcctgcgcggcagcgtcgtgcgcttcatccggctgttctcggctgcgcacgctgaaaacgcgcaggacgatgcgctgtccgcgatgggctttcgtgaactgctgtccacgctcgaagacgacgcacgcaccgcccgcttcacgcgcctgcccgaactcgaacgggcgatcggccaggcgcgccacctcgaacgcacacgcgacgacgtgttctccgattcgttcagcaacgacccggccgcgatgcgcgacgcggtcgccgcgctggagcgcgtcgacgtgctgttcgtcgggctgtgcgtcgagtacgtgatggagcggcacgcgccggcatcgcgcctcgtttcactgtccgccccggcatcgccctccgccgccctgtcgctcaccgaccgcccaaccgcgctctgctgaccgcaccacgccgcattacccggtgatttcccgaatttcgttcgttatatcccatggtatatttcgcgaatctttcgcgcatccgtctccggcccgaccgtgccggacagaggtcaacatgcacgttccgccctttcgccttgcccgcacggccgatctctcgtcgcccggcggtaatctgcccgcggcaaccggcacgcgggtcgacgcatgctgcgcgccgtcgcgcgcgcaactgaccgagctgaagcgccgcacgcgcctgtccgagctcgatgcgaacctgcactgttcgatcatcggcacctgcctgaccacgcacgagctgcgcaggctcgtgccgaaatacaccgacctcgaccgccagcacgcgaccgacctcgacatccatcacgccgccgtcgagctcgcgatcgacggcacggccggcgccaaggcattgcacaaggcgctcgacgagcgttacgccggcgcgatccgcgcattcgacagcgcacaggatgcggatgacctccttgcgcgctggaaggatgcgctgaagagcggcgacatcccgcccgcctactgggcgctgatgacgcatccgcgcacgacgatggccgtgcgccaggccgcgttcggcgacctgcacatgctgtcgcacctggtcggcgcggccaatcgcgccgatatccggcggctggtcgcgctggaggaggagaatgcggcgctgcacgcgaagatcgaccggcagcaggcgcgcctgcaagaaatgagcgcgcagcgcgacgcagcactgcaggagcgggatgccctcgttgcgcgccggaacgcacagccgccggcggctgaaagcgcattgcgcgacgaagtccacgaactgcgcgaggcactggccgcgcgcgatgagcgactcgcgctgcacacgagccgccgcgaggctgccgagcagcggatcgccgcggaacaggcgagcgcacgcgcgatgcgcgcgcggctcgacgacctgatggcaatggtgaagacgctacgcgccgaagcgagcgcgatcgaacaggcggtgcaggcgtcggcggacgatcccgccgaacacgcggccgatccgctgtcgatcctgcggggcacgcgtctggtctacgtcggcgggcgcccgggctcgaaccgtgcgatcaggcggatcgtcgaagcggcgggcggtgacgtgacgctgcatgacggcggtatcgaggatcgcaagggcctgctggccgccgcgctaccgggcgcgcacatggtcgtgttcccggtcgactgcatcgaccacgattcgatgaacctgctcaagcgcatctgcgaacgccaccacatcgcgtactacccgctgcggacggccagcgtcgccagcttcgtcgaactgatcgggcggctcgatgcacaggcgcgcgacgtcatggcgccggatgccgccggcggcacgccgcgcttctgcctgcggcacggctagacctgattcgcttcgacgcgctccttctgcccttcagcgggtcggtgcaagcgcgtcgtcggcgtcaacaggccccgcgcttcagcgccgcaccattttcgtgagcgcggcgatttcgtcggcacacgccgcgtaggcgcgcgcctcgatcccgcgatagaggcggatgatctcctcgccgaccggcgtgagcacgctgccgccaccgctctgcccgccatgctcggacaccgtcgccggcgatttcagcgagcggttcagctcgtccatcagcagccacgcacgccggtacgacatcttcaggctgcgcgccgccgccgaaatcgaaccgtgttcgtgcacggcttcgagcagcgcgaccttgcccgggccgagcgcgatcgtgtcggcctgctggatacgcatcctgaatcgcacttcaggcttggggtgtgccggtgtcttcatgttgtgctgccctttgaacgatgcgggcaagcatacacgatggccgatgcgacgcatgccggccgcccgcgcgccggttcagacctcgagcacgcgggcgacgatgccagccagccgcttcacatggcgcggcgcgggcaggaggtcggcgcccgagaacagcagcggcgcgccgtcgtcgatcgacagcggcgcgtcgccgcattcgaacgcgacgatcacgtgttcgccgaccggcgtgttgaacagttcatgccaggaaaacgtgaccgcgtagccgtcgtgcgcatgcgcgacgaacaccatgcgcttgaagtcgcccggcgtgtcgttacgcagcccggccgcgtcgagcaggtccttcagccgtgcgccgcgatacggcgcgaccgagcggatgaagcgattcgtcgtgaagcagcgcaggtcgaacggctcggccgtcgcgctcgcgtgccggcgcagatcgtcgagggtcaccgtcatcggccgcacgaatgcgcccgtcagcacgatcgagcctgccgccgcctgttgcgcctgttgcgcctgttgcgcctgttgcgcctgtcgcacctgctgcgcctgctgcgccgaaagcgccgccgtccctgccctctccatcgcccccttccatgacggcctgccggtgggcaggcctgcgtcgtatcggcggatatattacgccgggaaaaaccggccggcggaatgcgcgccgcatgggcggcataacgccggccgatcgcgccccgcgccgcgcggcgctacgacagcacgatgttcttgatgaccttcttcaggctcttgaagctgtcgaccgattccgccttcgcgtccgtcaccagtgcgccgatccgcgccggctcgcagaagctgatcctgctgttcgtgccgagcttgctgaaatcggccaggatcgcgacgtccgccgcgttgctcaccatcgcgcgcgccacttcggtttccatccggtcgtagttggtcgcgccgcgaacggcatcgaccccgaccggcgacagcagcgcgaggtcggcgcgatagcggaagatctcggcgaccgtgccgtcgccgacggtcgcggccgcgcgggtgccgatcatcccgccgagcaggatcgtctcgttcctcgcctgccccgggtcgctcgaccgcatcttcagcgcgacgtcgatcgagttcgtgacgatcgtgaggcccgacagcttcgccagttcctcggccagcagtgtcgtggtcgtgcccgcgtcgatgaacagcgtctgcgagcccgtgaccagcctggccgccgcgcgggcgatcgccagcttcgccttcacgtgggtctgcgcgcgttcggcgatcggcgcttcgtcgcccacctgcaccgcgccgccgtgcacgcgcttcagttcaccgagcgcttcgagatcgacgagatcgcgacgcacggtttcccgcgacacgttcaggtcggccatgatccggtcggtggaaacccgctgcatcttcgataacagaagccggatcctctggtatcgctcttcttgccacatggaatgtcctcggagtgaacgtcaatgttattcgaacggcgaactacgcagcgctctcctccagtttttgatgccgacgagggtctgcagggattgacgcaccgcctggcactcgctgctcgtcatcttcgaaaacaccacgtggatgcggtcgtcgtccggcgcgacgtcgtcctgttcgatgatgaaccggacgatgcgcgcctggtcgatgccgggcatcgcctgcagcgacgtcagcttcacggcgccgcggctcgcgaggatacgcacgccccagcgctgccgcgtcgcgaacaagcgcttctcgatcggcttcaggccggccaggatcgcgagcacgatcgccgtcgcggcaatcgcggccacatacatgccgccgcccacggccagcccgaccgccgccacgacccacaggctcgccgcggtcgtcaggccgcggatgatctcgccgcgcagcatgatcgaaccggcgccgaggaagccgatgcccgacaccacctgcgcggcgacgcgcgacgggtccagcgacacgttcttcgcgttctggacatccgcgaagccgaacgccgacacgaccatcacgagcgcggcgcccaccgccaccagcatatgggtgcgcaatccggccgcccacgacaggcgctcgcgctcgatgccgacgaggctgccgagcaatgccgccagcaacaggcgggacacgatttccagctgactgatcattcgagatctccttgctttgcctggtccatccgatgaggcgcggcccgcatggggccgccgtccggttcttcctgcctgcgcccgcccgttgccgcacccggcacccggcgagttgtatttttgtgcgatcttgtgattttgtgcgttctaatatacggtacgaaaaactgcaaagccagacccaagttcgtttgtttcatccgatcgacacgatcaatcgtcagaccattcaggcaacacgatccggaacacttgcttaggagaccaacatgatgaagaaggcatggatgctggccgcaaccctgctggcggcgctggcgacggcccccgctcacgcatcggaaggcgacgtctgcaaaaggtgacgctcggcgacgtcggctggagcgacatcgcggccaccacaggcgtcgcgatgatgctgctcgacgggctcggttacgaggcgaccaagacgatcgcgtcgccgccgatcgtgctggccggcgtgaagaaggcgcagatcgacgcgttcctcggctactgggatccgagcatgacgccgacggtgaagccgttcgtggacgccggcgccgtccaccagttgccggagcccaacctggtcggcgcgcgctatacgctggccgtgccgcaatacgcatccgacaagggctcaagcgcttcgccgatatcgccaggttccgcgaccagctggacggcaagatctacgggatcggcgccggcaacaacggcaacgcgctgatccagcgaatgatcgacaagaacgagttcgggctcggcggcttcaagctggtcgaatcgagcgaggccggcatgctcgtgcaggtaacgcgcgccgtgcaggagcaccggatgatcgtgttcctcggctgggagccgcatccgatgaacatcgactaccggatcacctacctcgacggcggcgacaccgtgttcggcccgaactacgggtcggcgaaggtctacacgctcgtcacgcccggctatctcgaacgctgcccgaacgttggccggctgctgaccaacctgaagttcacgaccgacgaagaaaaccagctgatggtgccgatcatgaatcacgcagacccggtcgcggtggccagggaatgggcgaagaagcatccgggcgtgctgtcgaagtggctcgacggcgtgacgaccatcgacggaaagaatgcgaaggatgcgatcgagaagctgatcggcgcatgagcctgcaagacaaggaacccggcatgtacaagaatctcgcgctgttcgatctcgaccacacgctgctgccgctcgacagcgaccaggcctgggcccgcttcatctcgcgggtcggctggcgcgaggacgacgcgcacgccgcgctgatcgacgagcactacggccattacgcggccggcacgctcgacatgaacgcgtatctcgccgtgacgctcgcgccgctcacccgctatccgcgcaaggtgctcgagcgctggcacgcgcggttcatggacgaagtgatccgtccggcgatcacgccgcaggcgcgcgagctggtcgggcggcatcgcgaaaacggcgatctctgctgcatcgtgacggcgaccaacgtcttcgtcacgcggccgatcgcggccgaattcggcatcgagcacctgctcggcatcgaactcgataccgacgacggcacgccggacggcgcgtttaccgggcgcagcaccggcgtgccgagcttccgcgaaggaaagatcgtgcgcacgaccgcgtggctggaatcgctcggctacgcgccgtcggatttcgagcgcacctacttctacagcgactcgatcaacgacgtgccgctgctggattacgtcacgcatccggttgccaccaatcccgattcgaggcttttgcaggtggcaggcacgcgcgggtggcctgtcatgaagttgttctgattcgggcgatattctctgctgtccattttcatgtcgggaggggtaatgaaatacggaacacgcagcaacggcctcgatcattcaggaatccgattcgagtcgagtcgaaagcatgtcgtcaggtcgcgccgatcggaaagccgctttccgcactggcgcggcgttttcatgatcgcgctgctgtgcacgctggccgcttgcggcgatggcgactcgggcaccgcggccaacgtggcggccgcgcgcggccgcaccgggttcggcatccacgcccgtcctgcactgcgcgagcgcgtgccactgaccgacgctggccccggagccagccatccacgacagagagcgatcatgcaaaacaaacccacgacacgacgtcagttcctcgccgacgcgttgaagctcgccggcgcgaccgcgatcacgggcatgctgcccgaaagcatcgcgcgcgcccaggccattccggcggccaccgtcaccggcacgatccaggacgtgaagcacgtcgtgatcctgatgcaggaaaaccgttcgttcgaccactacctcggcacgctgggcggcgcgcgcggcttcggcgatcctcggccggtcgtgatttcgagcgggtatccggtgtggcgccagccctggctgacgtcctacgtgtttccgttcaacccgtccccgccctccggcacggcgaacggcgacacctactacggcgacctggaccacagctggaacggtacgcacagtgcctggaacaacggccgctacgacaactgggccgacgcgaaaaccagcggcacgatgtactacttcacgcagaaggacatcccgttctactacgcgctggcgagcgcgttcacggtgtgcgacgcgtaccactgctcgatgctcggcccgacggacccgaaccgcctgtatctgtggaccgggtgctgcggcaacgtcgccggctactcgccatacacgacgaacacgatgacgggcaccggctggaccacgatgccggagcgcctgaacacggccggcgtcacgtggaagttctaccaggacaagggcaacggcctggatgccgcacatggctacggcgaatacaacggctccaaaagcgatctctggtggaacggcaattacggcgacaacgtcatcctgaacttcaggcaataccagaacctcggtgcaggcgatccgctcgcgccggcgctcaacggcacgcagatcgacccgtcaggcggcggcaaggaatacgacacgaacctcttcagccagctgcgggccgacgtcgccaacggcacgctgccgcaggtatcgtggatcgccgcgccctacgcatactgcgagcacccgtcgtgggccgcgagcggcggcgaatggtacgtcagcagcgtcctcgatgcgctgacgtcgaatccggcggtgtgggccagcacggtgctgctcgtcatgtacgacgagaacgacgggctgttcgatcacatgccgccggccgtcccggccagttccgccgccggcaccggccggtccacggtctcgacgtccgccgaattcgtctccggcagcggcgccgcatcggacggctcggcgagcggcgacgtgccgatcgggctcggcccgcgcgtgccgatgttcgtgatctcgccatggtcgaagggcggcaaggtcaattcgcaggtcttcgatcacacatcggtgatccgctttctggaagcgcgcttcgggctacaggaaaccaacatcacgccgtggcgacgcacggtctgcggcgacctgacgtcggccttcgatttctcgaacgccgaccggacggttcccgcgatccagccgccggcaagcaacatgaacccgaacggcccggccgtcccgatcccctacccgaccaccaccgcggtgccggcgcagacggccggccgcagcaccgcctgccgcctgccctacgagtttttcgtgcaaggcaaggtcaatcgcgccggcaacacgctgtcgctgacgatgaccaacaccggcaccgccggcgtccacctgcaggcgtgggtcgacggcacgaacacgatccccggcactacacgatcgcggccggcgcgggccagtgcgcgaacctgtcggattcgctcgcgctgaatgccggcggcagctacgactattccgtctacggcccgaacggcttcctgcagacgttccgcggcagcatcggttcgtccggcaacacgggatcgaccgccgaagtcagcctgtgctacgacgtggccaacggcaacgtgcagatcacgctcgacaactccgccggctcggccgcgacgacgttccagctcaccgacaacgcgtacggcatgaacacgcggcagtcggtcaccgtcgccgccggcgcgacgcaagccgtcacgtggtacggcgacggcggctggtacgacgccagcatccgcgacgcgaacgatccgaatttcctgcgccgggtagccggctgcgtgcagacgcaatccggcaccctgctcacggattcggcgatcggcaataccggcaagaagttcgtcgcgtcgctcgcgtcgcagggctcgacgttcggcacgctgcggttcgactacgttgcgccgccgtggagccacagcccgaagaactgggtgggcatcttcgcgcatggcgcgcagccgaccaagggcagctacaagtcgtgggcgtacctgccgaaaagcaccggctcgctgctgttctcgtccacggccaacagcacgctggcgtcggggcaatacgacgcgtggtatctgttcgacgacggctacacgccgctcgcggggcccgtcacgatcaacatctgacggtggcttgaccgtgccgtgccggccgcctgcatggggccggcacgcattcgggcgcgacgtgccgcgctgtgcccgaatgcgtttcccttcgccctgcccgcgcgacaggcgctacccgagcagatcctcgtggagcgcgccgaacggccgcgtcaggcgcgcgatctggatttcgaggatccacagcccggccgccggcgcggcatcgaaatcgccgaggttgccggccgtgtagatcaaccggtgcagggtcgcgcttcgtcgcgcccgacagcaaaaacgggcgctccgatggagcgcccgctcgcgggtgaggtcgatcagaacttgtgacgcaggccgatccgcgtgacgaactgcgtgttcgcgcccgcgttgccgatgaacgaacccgacgagccgatctccgcctgcaccggcaccgcgcggccattgatcgtattgctgcccgacgccttctggtaggccgcgatcacgtacacgtccgtgcgcttcgacagcgcatagtcgaccgcggcgttgacctgatgccacttgccgtcgaagcggccgtcgagcttcgagaacgtatagccgaggccgccgctcagggccggcgtgaacgcatagcggccgccgatttcgtagttgttcagcttcgacgattcgcccgacagcggcacgaacttcgtatgcgtccagttcgtccacacgagggccgccgcgatcgcataacgcgcgccgacgccgaccgtctcgagatcgcgcagcccctgcgtgttgacgttcgcgatgccgacgccgaacgcgggcgtcgcgccgttcgggaagcggatgttcgtgtacgcggcgccgatgccgaacggcccctgcgcatagttcgcgccgaagctgtatgcgctcgacgaaccctgcgaaccgttcgcgccggtcgtggtcggcgtgcccgcgaactgcgtcgagttcgagaagccgtacatcgcgccgaacgtgaggcccgcaaagttcgcgctctggaacttcacggcgttgttgatgcggctcgacgtcagctggtcgagatcgttgatgtgatacgcgtagttgccggccggcgtctggctgcccatcgcgtagttcgcgccgatgtagtcggtcgagaacgaatactggcggccgaatgtcaacgagccgatcccgttcttcgacagcccgacgaacgcctgccggccgaacagcgcaccgccctggccgatcgcgccgtcaccgctgctgaagccgttctccagcacgaacagcgccttcagcccgccgccgagatcctcggtcccgcgaatgccccagcggctgcccgacgcgacgccgtcaccgtacttgacgagcttgccgtggccgcccgacgtcgcgaccttgttcgaatacgtgatacccgcatcgatcagcccgtagagcgtgacgctgctttgcgcgtgcgcggcggtgccgaacatcccgagtgcggctgcggccgcgatggtctttcatgttcacttcctgttgttgtcgacgcgcgcccgcgtcgcagcgtgacgcgcggcgtgttgacgaatcaccgactgattgacgaacgcgagccaccggatcgccgcgcgcacatacacctcatgcacatgcacgatgcttcgtttcggtaccggtatgggcttgctgatgtggcatgccgcggggcggccgcctgtgttgcagcgcctgcgcgcgtgcgcaccgagtgcgcatgccgcgacgacgcgttgctccggcgatgcaggtcagaatctcttccggctttcgtggagcgggtggacgacgtggcgcctgacgacgccacgaccttcgatatatttttcggaatatatcgagttgtcacgaaacggtaaacaattattcgggttcctgtcgtctttcctccacaggcggccgacggtcacccggatcgaaatcgcgacgcacgacggcccgcatcgcgtcgatgccggcgacggcctcatgccgaaatccagcataatcaggcggttgaaagagcgccctcgccggcgcatgcaccccgcacacgtttgcgtcgccatccggttcacggtttgcccgcatttcgccgtcacgggaggagccagtctgtgccggtctcgcgcacggcgaactgtgcgggcgcaaaaatccgcggcacgcacacactcgatgcggcgcacctcacgatgccggcgatcgcatctccgacgacaccacgccatcccgcagaagacaggacaccgacacatggaccgagccgaacacatcagcatcgaacagacgagcgcgcttcccgccgacgaactggatcgatgcgacttctcgttcgacatcgcgtgggaattgaacgcgccgtatcaggacttgctcgatctgcgcgcgctgccggcgcgccgcaagcactacggcttcgatccggccggctgggcggacgaggcgaccggcaagacagcgctctttcgcgcgacggccggcggccggctcgccgggttcgtggcgatcagccagagctggaacgggatggccgagatcgcggagctggccgtcgaccgcctcagccgacggcaaggcatcggacagttgctgctcgcggccgccgaatcctgggcgcgcagccacgggttcggcttcatgcggctggagacgcagtcgaacaacatcgccgcgtgcagcacctatgcgcgctcgggcttcgtgctgggcgggcacgatcgcctgctgtacgcggacgacgagaacgacggtgaagtcgcgctgttctggtacaaggacctgcgcgacgggcagaccgcacggatccgcacggtcgacccggaatcgatgcggccggcgcgctgacgcatcgccgaacgcgcgtcagcgccggatctcacgcgcatcacatccggatcatgcccgcgtcgccacgatgaacagacgcgggaacggcagcagcacggtgccgtcggcaagcgccggatagccgcccgggcccgcgatcgcgtcgcgataccgcgcgagaaacgccgcgcgctcgccgtcgtcgagcgccgcgaggaacggccgcagcgcgctgcccttgaaccattcgacgaccgcatcggcaccgccgcgcagcgggtggtagtaggtcgtgcgccacacgtccacgcgcgagcacagcggtgacagcagcgcgtggtaatgacgcgcatcgaaccgctcggtgcgcgccgcgcctttcagcttgtccgcccacggcccggctgcggcgacctcgcgcatcagccgatgcgcgggttcgtcgaggttgtcgggcatctgcaccgccagatggccgcccggcgcgagccggccgacgagtgccggaaacagcgtgtcgtgcgcgggcacccattgcagcaccgcattcgcgagaatcaggtcgtagccgccgggatcgtcccacgtggaaatatccacgacgtcgaaacgcaggtccggcaggcgcttgcgcgcggcgtcgatcatgtccgccgacgcatcgattccgtggaccgttgcgtccggcgcacgcgcgatcagcgcctccgtcgaattgccgggcccgcagccgatgtcgatcgcggtacggatcggcgtgttcggcacagcggcgagcagatcgcggatcggccgcgtgcgttcgtcctcgaattgcacgtactgggccgcgtatcgatcgagtggggtcgtcatgtcgttctcctcgtggtcggcgtggacggccgtgccgctgccggcgtgcgcggtgcgggggccgtcgatgcgaagcattctgcggtcgtcgtgaagttcagtaaaatgaatttaatatcgtgattgattcaaaattctgatgaagatcgatacgctcggtgttcaggctttcgtcgcgatcgccgacggcggcagcttccggcaggcggccgatacgctgcacgtcacgcagacggccatcacgcagcggctgcgcaagctcgaaacctttctcggcgtcgcgctcgtcgagcgcaccacgcgccgcaccaccctcaccgaaatcggccggcgcttcctgccgcaagcgcgccggctgctgaacgagctgtccgacgcgctcaccgaaattcgcgaaaccggcctgagccagcgcggcgacgtcacgatcgcgtgcgtgccgacggtcggcgtgcaatacctgccccgcatcctgcgcgcattctccgcgcaccgcccgcacgatcgcgtgaagatactcgatcacgcgtcggcgtcggtcctgcaggccgtgctgcatcgcgaggccgagttcggcatcggcatcgccggcgaccagcatcccgaactggtcaacgtcccgctgacgagcgacccgtacgtactcgtgtgccgcgacgatcatccgctcgcgaagcggcggcgcattcgctgggccgccctgcaaccgcatccgctgatcttcgccggcgaagtgagcggcaatcgcgggctgctcgacggcgcgctgaagacgagcggcgtgtcgctgcattcgttctacgaagtacaacgcagctcgacggcgctcgggctcgtcgcggaagggctcggcgcggcggtggtgccgaagctcgcgatccagaagaacacgtacccgatgatccgcacgatcgaactcgtcgagcccgcggtgtcgcgcacgctcgtgctcgtcacgcgccggagcgcgcaactgtcgccggccgcccgtgcgctgtacgacatgatcgtcgaacaggcgacaccctctcgatagtgacagtcgcgcgtcacgaaggccatgccttcgggtagtatcgcgtcacgcggtcgcgacgaacggtgcctacccggcgccgcacgcgtcgtgccgccgctgcaacggccgttcctcaccacccctgcacggagcaccgcatggcctatcgcaactaccacaagcgcaagattgcagaccgggaactccatcccgaaacccagatgatgtcgtacggctacgatccgttcctgtcggaaggatcggtgaagccgcctgtgttcctcacgtcgacgttcgcgttccgcacggccgaggacggcgccgaattcttcgacgtcgtggccgggcgcaagccttcgcccgaaggcgaaggcgcgggcctcgtctacagccgtttcaatcacccgaacctggagatcgtcgaggatcgcctcgcgctgctcgacgattccgaagccgccgtcgtgacgtcgagcggcatgtcggcaatcgccgcgatcctgctgacgttcctgcggccgggcgactgcgtcgtccagtccgtgccgctgtacggcggcaccgaaacgctgatctcgaagttcctgcccgagtggggcatccgctccgaagtgatcgccgacgggctgtccaccagcgcgatccgcgccgcgctcgaagcggccgcgcaaagggcaacgtgcggatgtgctacatcgagacgcccgccaacccgaccaacgcgctgttcgacctcgacgggctgcgcagcgagatcgatgcgttcgaggcacggcacggctatcgcccgctgtcggtctgcgacaacacgctgctcgggccgctgtatcagaagccgtcgcggcagggcatcgacctgagcgtgtactcgctgacgaaatacatcggcgggcatagcgacctcgtcgccggcggcgtgacgggcacccgcgacctgatcacgaagatccgctcggtccgcagcacgctcggttcgcagctcgacccgcattcgtcatggatgatcacgcgctcgatggaaacgctcgtactgcgcatgcagcaggccgcacgcagcggcagcgccgtcgcccgctggctcgccggcaatccgcatcggccggtgcgcgtgctgcatcccgaactcatcgacgatccggcctaccaggccgtctaccggcgccagtgcagcgggcccggctcgacgttcgcgttcatcctcgacggcggccgcgagcaggcgttcaggttcatcaaccacctgacgctcttcaagtccgcggtcagtctcggcggcacggagtcgctgatctgccatccggcatcgacgacgcattcgggcgtgccggccgaagcgcgcagcggccggtgtgtcggaagggttgattcgcgtgtcggtcgggctcgaacatccggacgacctgatcgccgacctgtcgtacgcgctggagcattgctgacgcggacggcgtgtgccccgtgccaccggtacggggcacgctaccgacgcccggacgccgacgttcgagctccgtcgtcgtgctcgctcgaggatcaacacgatgaacaccacgcggcattcgtaccggatcgccgatctgcaaggcgtgccgatcgcgaccatgacgatcgtgcaggaaatcgacaagctggacgcgttgcccgatcgctgctgcacgggccgcgtgtccgtcgaattcgaataccgggagtcgccattcggatcgcccacccgggtcaggaaattcccgttcagcgaacgatggcttccgctcgacgattcgtcgttcaagatgcacatcggcgacttcatgcttccgccggaattgtgctgtcggggcatcggcacgctgtgctggtcggagatccatcgaacgcttccccttccgccaggcttctcgctcctgctcaccggcagcctcagcgacaaggacgcaacgatgaccggccacattctcgggaagacgcaaacgatcgacaacatcgaacgccggaatgcattctggcgccgcatgctggatccggcccatcagacgctcgtatccgacgcgaacggcgacggatatttcagaggccggttcgtcgatccggccactcacgccagctatacgcccaaggcgatcgccacgagaatctgagcgcgcgacgcgcgccggccgaaccggttcaaagcaccttcaccatgaacacgcgcgacgtgccttccggttcgcacggcacttcgccgaatgcttcgtaaccctgcttccggtagaaatccggcgcctggaacgagatcgtgtagagcaccgcccgcgcgcatccgcgtcgtttcgcttctgcttcggcctcgcgcagcagccggctgccgaacccgccgccgcgcagcgattcgggcaggtagaacagatcgatgaagaagagaccgagcgacgtgcgccccgtcaggccgccgacgatctcgcccgtcgcgggatcggtcacgtacacgtcgagcgtggccgcgtcggcgcgccccgtcatcgcgtgattgaattcgccgagcttgcggctgatgaaatcgtgcgcggccggctgctcgatgtcggtcagtcgcagggtaacgtcgggaagggctgtcatcgggagagcgcgtcagtgaaagggccgccgggtgtatcgcaccgtcagcgggcgtcgcacgactatagcgcgtcgcccgccgcgtggcgaccgcgccgctcgcgcgcgatatcgcgtgcgatgtggcattcccacgcgtcgttcggccacatcgggaacccgaaacccggctccgaaggcaccatcgcgaatcgcggcggctgcgccgccttgcacgtggcatcgtcgccgttaccgtagccgacccactcggtcatgagcgagcgcaccgcacacgatcgccccgtttccctccccgagcaagcaaccactgtaagcggcgggcccgtcatgcgcccgccgtcgctttcgtcatgccgtcacaccatcatgcccgcgctcacgctaccgcgaacgccgccttcatgtcggccacgcggcgccgttcgcgcgcgatcatcatccggttcacgacgatcacgccgatcgtcacggccgtgatgaacagcgtcgccagcgcgttcatctccgggttcagccccagccgcacgcgcgagaacaccaccagcggcagcgtcgtcgaccccggccccgacaggaacgccgacagcaccaggtcgtcgatcgacagcgtgaacgacagcagccaccccgacagcagcgcctgcgagatcagcggcagcgtcaccacgaagaacaccttcagcggcgtcgcgcccagatcgagcgccgcctcctccagcgacttgttcatctccttcacgcgcgactgcacgatgatcgccacgtacgacacgcacagcatcacgtgcccgatccagatcgtcaccatcccgcgccccttcggccagccgaacatctgctccagcgcaacgaacagcagcaacagcgagatgccctggatcacttccggaatcaccagcggcgcgttgatcatccccgtgtacagcgtgaagcccttgaagcggccgaagcgcgcgagcacgaaacccgcccacgtgccgatcaccaccgacgcggtagccgtcaacaggccgatcttcagcgacagccacgcggcggtcagcagctcgtcgtcgtccagcagcgcgctgtaccacttcagcgagaagcccgaccacaccgtcaccagcttcgactcgttgaacgagtacaccaccaggctgataatcgggatgtacaggaacaggaagccgaaggcgagaacgcccgtcgacagcggtttgctcggcttgatcatttcgcgtcctccagttccttgacctggtagtactggaacagcgccatcggcaccagcagcagcatcaccatcgcgaccgtcaccgcggacgccatcggccagtccatgttgttgaagaattcatcccacatcacgcgcccgatcatcagcgtgtcggcgccgcccagcagttccggaatcacgtactcgcccaccgccgggatgaacaccagcaggctgccggcgatgatcccgttcttcgacagcggcagcgtgatgcgcgtgaacgcgacccacggcttcgcgccgaggtcgtatgcggcctcgagcagcgtgaggtccatcttcacgaggtgcgcgtacagcggcatcaccatgaacggcaggtacgaatagaccatcccgatgtagacgcccgcgtcgctgtgatagaggcgcagcggcgtgtggatgatgcccagcgcgatcagcgtgtggttcaggaggccgtcgtccttcaggatgccgatccatgcgtacacgcgaatcaagaacgacgtccagaacggcagcatcacggccatcatcagcacgttgcggcggttcggttccgagcgcgcgatgtagtacgccatcggatagccgatcagcaggcacagcacggtcgacacggcggccatcttcagcgagctgaggtaggtcgcgatgtacaggtcgtcctgcagcaggaacgcgtagtgcgacagctgcagcgcgaagtgcacgacgccgtccttgatctcgacgagcgacgtgtacggcgggatgcccatcacctggtcggcgaagctgatcttcagcaccagcacgaacggcagcgcgaagaagaccgcgagccacacgaacggcacgccgatcgcgacgctgcggcccgacggcaggaagcgcgacagcacggagaagcggcccgggcgcgcgcggccggcgccggtgctcgcggcgccggcagacaccggcgcggacggagtggaagcggaggttctcatcgtggcctcctcactgcgtcagcacgacgccgctggccggcgaccacgacacgaacacgtcgtcgttccacgccggtgcgttgtcgttcatcaggtgcgagctcgacaggttcgacaccaccgtcttgccgctcggcaggcgcacgtggtacagcgagtagctgcccatgtacgcgatgtcggtcacgacgccgcgcgcccagttgtgtttcgagcccggtttctcgcgcgacacgtgcacgcgctccggacgcaccgagatgccgaccggcatgccgagcgggcccgtcacgccgtggctcacgtacatgcgcgcttcgaggtcgtcgctttcgacgaagatgtggtcgggttcgtcctcgaccacgcgtccttcgaacaggttggtcgagccgatgaattcggccgagaaacggctgttcgggtattcgtagacctcgccgggcgagccgatctgcacgatcttgccttcgctcatcaccgcgaggcggctcgccatcgtcatcgcttcttcctggtcgtgcgtgaccatcacgcaggtcacgtcgaccttctcgatgatgttcacgagttcgagctgggtcttctggcggatcttcttgtcgagtgccgacatcggctcgtcgagcagcagcagcttcgggcgcttgaccagcgagcgggccagcgcgacgcgctgctgctggccgccggagagctgatgcggcttgcgcttcgcgtacttgctcatctgcacgagcgcgagcgcgtcggccacgcgttccttgatttcattcttcggcgtgccttcctgcttcaggccgaacgcgacgttcgattcgaccgtcatgtgcgggaacagcgcgtacgactggaacatcatgttgaccgggcggcggtacggcggcagcgacgcgaggtcctcgccgtcgacgaagatcttgccggaggtggccgtctcgagcccggcgagcatgcgcagcaacgtcgacttgccgcagcccgagctgccgagcagcgcgaacagctcgttcttcgcgatcgtcaggttcacgttgtcgacggccgtgctgtcgccgaatttcttcacgacgttttcgatgcgcacgaacgtgtcgttcggcttgagcatgttcgtcgtcggtcgatgcatcgcatcaggtgtactgaatgaatcccgtttcatgatggtccgtttcaagcaggtaagcgaatctcaggcgtcacgcgcgaccggcggtagtcgggcggtgctggcggagagggatcgagcgattcctcgtccggaacgaatggcgcaacgaaacaggcaggaaaacgcacggcgatcgatggcgatcagtcgcgaacgaccgcggccaccgcgctggctgtcatgaagatttcatcggttttcatcgggctttccgcacgttttcgtcgtctccagtgcgaatttttaaacctgtcaaaaaccttttggatcgcggatttccgttccggacattgaacgggatcgatgtttgggaagggggaaaacggggcacgacccgcctcgcgcggcagcgcgggcgccccggcggcacaggcgccgccggatgacacggaagacgaaacgaagggtgggaaaacgagcagccgggcggctgcaacgcgcggcctgggcgctgcgcgggtggcgtcacttcgcgttcagttccttccagcgccggtacacgtcgatcgcgccgccgcgcttctgctgcaccatcggcagccggcgcgcctcgatcggcttcgcatattcggcatagaacgtgtcgagctcgaaatacttgcggtcgtctcggtagaacggcgcgtagtcctcgcgcgtcgtgatgtagaccacgcgtttcgggctgcagtagtacagcgcgccgagacacatcgggcacgggctcgcgagaatgtagatctcgcagtcggtcaggtgctcggtgccgagcttgcggcacgcgtcgcgcaccgcgaggatctcggcatgcgcggtcgggtcgctggtttgcgcgacgaggttcgggctctccgcgacgatctcgccgtcgcggacgatcaccgtcgcgaacggacggccgccctcttccacgttctgcatcgcaagatcgatcgtgcgtttcacaaaatccatggctgtgtcctcatcgaaacggcatggcgggaacgtgcgccggccggcggccgatgcacgtcgggcgagagcctgcacggcaccgctgccgcggcgccgcgccggcgtcagaacggcttggtcggcaggtacttgccgtcgagcgtgatcaccgcgcgcgaaccgccctccggatcgtcgaccttcttcacgtcgagccggaaattgatcgcgctgatgatgccgtcgccgaacttctcgtgtacgagtgccttcagcgtcgtgccgtacacctgcagcatttcgtagaagcggtaaatggtcgggtcggtcggcacgcgatcgtcgatgctgccgcgcagcggatcgtctgcagcagcagcaccgcgtcgtcgtcgaggccgagcttgtccgcgacactgcgcgccgcatcggccggcagcgcatgctggccgagcagcgcggccgtcacgaacgcttcgctcaggcccgtgccttcggtgagctgcgcgaacgacaggttcttgcgcgccttcgcgagaacgacggtctccgcgagcgcgtggcgggcggtctggctgtgctgggactggatcatggcaattcctcgtgggtgggttggagcgattcaggccgcgacgggaagcgtcgcgggcgtggcgcggacctcgggatggttcgccaggagacgaaccggccggtcgcgccgtcatgggcgtcgatgcagcccgattcgatgtcatagacccagccgtgcagcgcgagccgcccttcttcgagcgcgagccgcacggcggggtgcgtcttcaggttcgccagttgcgcgacgacgttctcgcgcaccatcgagtcgatccgctcgcgttcgctgcgatgcgtgcgcgcctcgttcacgacgcgcgccgaatcggcataacgcagccagtggccgacggccggcatgtggtccaagcactggcaagtggcaatcgcggtcatcgcgccgcaatcggaatggccgcagatcacgacgtcggtcacgcgcagcgcggccaccgcgtattcgacggacgccgacacgccgcccggctcggggccgtacgacggcacgatgttgccggcattgcggatcacgaacaggtcgcccggttcgcgctgcgtgacgagttcgggcacgagccggctgtccgagcacgagatgaacagcgcgcgcggatgctggctgcgcgcgagatcgcggaacagcgtggcgcgcgccggatacgcgtcgcgctggaacttcaggaagccttcgatgatgtccttcatcgcgtgttctccggtgcgggtggaatcgatgaagggcaggttacgccggacttccaataacgtaaaagactgatttatgatccaccggataagcaggacttataggaaccgccatgctgctgcgccatatccattacttcctggccgtcgccgagcatcgcagcttcacgcgcgcggccgccgcgctgcatgtgtcgcagcccgcgctgtcccagcagatccgccagctcgaggagacgctcggcgcgcagctgttcgaccgcaccgggcgcgtgacgcggctgaccgacgccggcgacgtgtatttccgctatgcgcggcaggcgctgcacgatctcgcggaaggccggcgcgccattcacgacgtgcaggatctcagccgcggcgcgctgcggatcgcggtcacgccgaccttcacgagctatctcgtcgggccgctggtcgaggcgtttcacggccgctatccggatgtgtcgctgtcggtgcgcgagatgtcgcaggaacgcatcgaggcgctgctcgtcgacgacgagctcgatgtcggcatcgcgttcgacgaggtgcagacggcggatctcgaagcgcaaccgctgctggtcgaaacgctcgcgctcgtcgtgagccgccggcatgcgctcgccggaaaacgcaaggccggcctgcgcgcgctgcacgacgcgtcgctcgtgctgctcacggccgaattcgcgacacgcgtgcagatcgaccgctatttccgcgagcacgatgtgcggccgcgcgtgtcgatggaagcgaattcgctgggggccgtgatcgagatcgtgcgccgcacgaacctcgcgacgctgctgcccgcgacgatcgcgagcggccacgacgatctcgccgccgtcgcgctcgatccggccgtcctgcggcgtacggccgtgctgctgcaacgcaagggggcgtaccggagcgcggccgcgcgcgcgttcgtcgaactggcgctggcgcatggggcggggcctgtcaggcgcgcgcgatgacctcggccgccggggtgcacggcacgcgccctggcgctaccggcaaccgatcgtgccgccgaaccgactcactggaacaccgacatgccgaacctgctacgccgcctgacactcaacccggttgccatcgcggcattgctggcgggcgcggcctggtggatccacgcgcagacgcgcgccgacggcccgtatcgcgtcgtggggttcaactacaccgatcgtggtgtctacagtttcgtggtggatggcttcggcgcgggcagcgtgcacgcgcgccagttcggcggcgggggcggcacgatgtgctgcatgagcgtgccgcgcggcaagaagacctggcacgtcaggatcacgtacgatctgacgcctgaagaagacgcccggaaccaggcgcccgacatcgtcgaaaccgacgtcgccgtgccggctttgccgaaccggcgcgacggttacatcgagttccactttctacccggccgcaagatcgacgcccgatgggtggcgtacccgacgatgccgcgcatgcgtgccaccgggtgatcgggaagggactgcgcagcccccgcccggcgctgcgtcagttgtaaccgagaatcgccaccgccgcgacgtccggccgatcgatcgtattcccgacgagcgacgtcatcggctcctgcagcacggcctgatacgacgtcacgcgcgcggcctccggcacgcccgcgtcatccggtgccggttcgtcgaacgcggcatcgaagccgctgtaaaaccccggttgcttctgcgaaaaagtcatctccactcctttacctgatcatgttttcgatgttctaaccgacctgcttcaacgccgccgcgtgcaccgccgtgccgtcatgtgcgccgtcatgcacggcttccgatcgcgccagctgcgcgcgcgtgcgccgcgtgatgtgaatcaccgcgaacacgaccggcgcgatcagcaggccttccgccagttcgggatcgaccggcaggttcatcacgtgcagcgccttgaacgccgccgtcgcgagcgacagcacgtagtacgaaatggctgccaccgacagcccctcgaccgcgtgctgcagatgcagctggttgcgagcggtgcgctccatgcccgccagcagtcgcgttacgtccttttcctgcgcgagattcacgcgcgtgcgcagcaggtcgaccgctcgcgcgatccgcgcggcgatctgctcgtggcgcgcccatacgctgcgacaggtttccatcgccggcgcgaaacgccgctccatgaattcggcgatcgtcggcatcccttcgatgcgttcctcgcgcaactcgtggatgcgcgccagcacgagcttctcgtacgcccgcgacgcactgaagcgcgcgcccgatcccgacagcgactcgacccgtaccgccagatgcgtgagcttgacgagcagcgcggtatcgtcgccgtcggcgccgctcgcgtccatccgctgcatcagtgcatggagcgccgcgtggatctcgtcgagttcgcggctcatccggcgcgcgacgggcagagccagcagggccatcatccggtacgtctcgatttcatgcaggcgctgcagcaggcggccgccctgctcctcgcggaaatcctcgtcgacgacgagaaagcgcatgaaaccgtcgtcgcgcacatgccagtcgcagaacaccttgccgccgccgagcacgttgctgccgacgagcgcgggcccgtcgatccagcggcgcaggtcgccgcagacgagccgcgcggcgtcgcccgtgagcagctccatgcgcaccgcgacgaagcggatgccggcaagccgcgcgaaccacgcggccggaatgccctcgatcgcgagatcgtcgaaataaccggtgtcgcgacgcggcgcgacgaacgtgaaggtcgagaattcggtgtggcgctcccacttcaggtgccagccgctcggcgactgcaccgcgtaatgcgtcgcgccttcgtgcggcgcggcgatgccggtatcgcggcacagcgcgtgcagcagcgtttcgtggatgtcgggctggccgtccgcgtagatcgcgtaatgcgtgagcgacacggcttcggcgagccgcaggaacggccgggcatgcaattccgcggccagcgccgcgcgcaacggatggtccatcatcgatacaccacgcttccctgttcagtcccgcacgccggatcgtccggcccgaacgccgcgccgccctcgggcgaaacgtcagcgtgatcgcactatggcagacacacagcaacaataaaaacgcataatgctgatcgttacgttcagttttcctgatacccatgaagatgctcgatcacgacgtgctggccaccgtcgtcgccgtcgcggagaccggcaacatgacccgcgcggccgaggccgtgaaccgttcgcagtcggccgtgagcatgcagatcaagagcctggaagacgcgatcgggcggccgctgttcgtgcgcaagccgcgcagcatcgtgctgacgcgcgaaggcgaggtgctgctgggattcgccagacgaatgctggcgctgcgcgacgaggcctgggcggccgtggtgcggccggaagtgaccggcaaggtcgtgatcggcgtgccggacgactatgcgtcgtcgctgctgccgtcggtgctgaagaaattctcggcgacctacccgaaggtcgagatccaggtgatggggctgccgagcagcgcgctcgcgccgctgatcaaggaaggcaccgtcgatctcgtctgcggcacgcgcatcaaggggctgtccggcgacttcatccgccacgagccgatggcgtgggccgcgatgacgaacgggccgcgcgtgtgggaagagcggccgctgccgatcgccgtgttcatgccgggcagcgtcgcgcgcgagaacgcgatccgcagcctcgaacgcgcgaaggtgccgtaccgcacctcgtatgaaagcccgagcctgctcgggctgctcagcatggtcgaggccggcctcgcggtcgcgccgctcgcgcgctgcgcgattcccgcgcaactgtcgatgctcggccgcgcgcacgggctgcccgacctgccgccgctcgaactgattctcgcgcgcagcacgaaatcgaagcggccgccgtgcgactttctcgcggaacagttgatggaagacctgcagcgtcagaccgggcagaccggcgacgcgtgatcagcgcatcgcgccgaacccggccgcgcccagtgccgcgttgacgttcgcggccacctgatcgacaagcgcttccagcgtatcgccgcatacccgcgtgtgttccggtgcgacgtgctccgcgcgttgccagccccactgcgcgcccgacgcgaccgacagcgtcgcgccgaagcggttgccgtggcggcggccgaaggtgctcacgcgccgcccggccacgtagtcctgttcgggcaggcaaagccggatttcgaccgcgacctggtcgcgatcgttgacgcgcgcggccgggctgaccgtcgcggcgaacaccttgccgatccgccaggtcacgtcgcgctcccacgccgcgagcggcccgccggccgcgtcgacccgctcggtgtccaccgaccactgatgccggtcgggcacgacgatcgcctgatgcaacagcatttcggccacgcgcaccgtcgtcacgagctgacgcgcgagttgctggcccgacggcagcgacgccgtccgtacccggccgtttgccggctgcacgacaggtactgcttccaatagatccatgactcctccgcatgcatgatcggcgccgcgcacgcagcatcgcgcgcctgtccgccgcctgagggcggacagcacggcgaccggcgaccggacggcggatcggacaagccatcaaggaacgaaccacaacccacgagcaacagccgttcccgacttcaccgtgccttcggcccgacgcgcaaccggcgcgcgaccggcccgatcaccgcatcggcctgctgcgcgatcagcatgtgcagcgtgaaatccaggtcttccggcgcgatgtcgaagcgcacgtgcaccacgtcgcgcacggcgcgcgcgctgacgacgtacacgccgagcggggaatgcagcagcgccgcgagccgcgcatgcgcgtgttctccggagtcggccgtcagcgtgacgggcaactgcaggcgcgggcgcggcggcgggaacggaatgacgttgtcgggtgcgccggcgcgcaactggcggccggcgacatcgaaggcgggaacgggatgaatgaaggtcatggagcggacggaagccgtctcggctgttcgacacgtccccagcttagaagagaccgcataaacgtcgtgcaaaaacgggccgcccgtgcaaaaacggcaccggggacacaacacgtcaacggccagcggcatggcggccggccgtgcggtcgcgatgcgcgcgccgcgaccgcccaccaaccgccacagttcgcgccaatcaaaccgtgcgtcggccgccgcgctacgcgaacgcttcgagcgacgcgcgccgccgctcgtcgaccatcgattcgatcagcgacaccagatcgtcggtcagcggatcgcagatgcccggcgagcgatgcagttcgagatcggccgccggcagcagcggcagcccgtccgtctcgtcgagcacgcgccagttctcgggcagcgtgcagcggtcgatcatcgtcacggccgcgccgtggttcaccgcgatcttgatgccggtcgggctctggctcgtatagacgacgtgatacggccgcccggccgtcgcgagcgcctgcagcccgcgctgccggtagcagcacgtctccggaaacagcgcgagcggcaccgacgcctgcgggccgagcacgaaatcgcggtgcgcggcccacacgacatcgtgacggccgagcagccgcccgcccgcgttcggcccgtgccgcacgacgagcgcgacgtcgagctcgccggcctgcagccgttcgagcagttcgagcgacgtgcggcaatgcacgtgaaagcgcgcgcccggccgcatcgcatagaacgacttcagcaggtcgggcagccacagctccgcgtagtcctccggcagcccgaagcgcacgacgccgcgatcgctgctcgcctgcttcagcgcgaggatcgcgtcgttctgcacctggatgatgcggcgcgcatggatcaggaaattctcgccgtcgcgtgacagttcgagccgtcggctgttgcgcatgaacaggtgcgtgtcgagccgctcctcgagcgtgcggatgcgcaggctgatcgtcgactgcgtgcgatgcagttgccgggccgccgcggtgaagccgccgctctcgaccacggcgacgaatgcccggatcagttccggatcgagcgaactgagcttcgaccaatcgggcctttgaatggcagccatcggaattactcgctttcgaaaaagaaggaagacgaaagatagggctcggagtacgccgattgttgtccggatgcgcccggccctccaacccctgcccgggtatgacaaacccggagccggttcacgaacgagcacccgccagttccgccccgcccgccgtcacgacaccggccgaggcccgcccggcgggcgtccgcgtgacgggcccagggctttccggagacgacgaaaactcatagcccgatcagaaaacatcgattcaccggccgcgccgcggcccaccacaatcgcctcacacccaacctcatcgacgagacatcgcaatgaccgcatcccaacccaggcagctttacatcggcgaaggcttcgaaggcctcggcgtcaacctcgcgcacatcaacgtgctggtcggcccgcgcaacggccccgcgggccaggcgttcgccacggccctcgcgacgccgtcggccggccatgcgccgttcgtcgtgatcgcgcagccgggcgtgccgaccaagccgctcacgctgtacgtcaacaaggcgcagatcgccggcgatttccacggcaacgccacgtggggcgcgtcgcaggccggcatcgcgaaggccgtggccgaagcgctcgagaacggcacgctgccgcccgaagcggagaacgactgggtcgtcgtgtcggcgaactgggtgaacccgcagaccgacgatctcgatgccgtgttcgagaacaactatcgcgcgtgccgcaccgcgatcgtcgccgcgatggaagggctgccgcatcgcgacgcggtattcgccgccgcgcgcgacgtgtcgaacccgttctacaccccgaagaaaaactgaagacgacaagcggccgacacaaggccgcacctggaggaagcatggaatacgtccgcctcggccagtccggcctgaaggtgtcccgcctgtgtctcggcacgatgaacatgggcaccccgactggaaaccctggatcttcgacgaagcgcagagcgagccgatcgtgcgccgtgcgctcgacgccggcgtgaacttcatcgatctcgccgatttctattcgacgggcgtcggcgaggaagtggtcggccgcatcctgaagcgcaacgcgcgccgcgaggagctcgtcgtgacgaccaaggtcggctacgacatgggcagctacccgaacgcgggcggccattcgcgcaagcacgtgctcgacggcatcgacgcttcgctgaagcggctcgggatggattacgtcgacatcttcatgctgcacttcttcgacgtgaacacgcccgtcgaggaaacgatgagcgcgctgcacgacatcgtgcgcgcgggcaaggcgcgttatatcggcgtatcgacgatgtacacgtggcagttcgcgaaaatcatgcaggcctgcgaacgaaacggctgggacaagccgatcaacatgcagctgcagctgaacctcgcgtatcgcgaggaggagcgcgagatggtgccgtactgcatcgaccagggcgtcggcgtgtcggtgttcagcccgctcgcgcgcggcctgctgacctgcgagccgcaatcgacgcgcaaccagaccgacttcttcaccgcgcagatgtacggcgatgcctcatcgctcgcgatcgcggaatcggtcgcgaaggtcgcgaagcgccgcggcgtgccgcccgcgcagatcgcgcaggcgtgggtgctgagccgccccggcgtcgcgagcatgctggtcggcgcggattccgtcgcgcagttcgacagtgcactcggcgcgctcgaaacacagctcaccgaagaggaattgcacgaactggagcgcaactacacgccgtgcgacctgatcaacgactacacggccggcaagcgcatcgcgcgcgcgtcgcgtccggcgcagggcagtttcgcgacggactgaggcactgaaggaacgacacacgatgaacgaatttctgaggaccggccattacatcggcggtgaatggcacgaaccgcatggcgcgagcgatgcgacctatccggtgctgaaccccgcgaccggcgaaacgatcgcgaaagtcgcgaaaggcggcgccgacgacacgcagcgcgccatcgacgcggccgcgcacgcgttccccgcgtggcgcgcactgaccgcgaaggagcgcggcgcacgcgtgaagcgctggggcgagctgatgctcgaacatcgcgacgcgctcgccgggctgctgacgcgcgagcaaggcaagccgctcgcggaagcgcgcggcgaagtcgcgtacgcggcgagctttctcgaatggttcgcggaagaagcgaagcgcatgtacggcgacgtgatcccgagcccgaagccggatgcgcagatcgtcgtcacgcgcgagccggtcggcgtcgtcgcggcgatcacgccgtggaatttcccgctcgcgatgatcacgcgcaaggccggccccgcgctcgcggccggctgcacgatggtgctgaagccgtcggaggaaacgccgctgtcggcgttcgcgctcgcggtgctcgccgagcgcgcgggcgtgccggccggcgtgttcaacgtcgtgtcgggcgacgcggtcgcgatcggcgaaacgctgacgagttcgcccgtcgtgcgcaagctgtcgttcacgggctcgacgcgggtcggcaagctgctcgcgaagcagtcggccgacacgctgaagaagctgtcgctcgaactcggcggcaacgcgccgttcatcgtgttcgacgatgccgatctcgatgcggcggtcgcgggcgcgatcgcgtcgaagttccgcaacacgggccagacctgcgtgtgcgtgaaccgctttctcgtacaggacggcgtgtacgacgcattcacgcgcaagctcgcggacgccgtgcgcacgctgcgcgtcggcaacgcgctcgcaggtgaggtcgaccaggggccgctgatcaacgaggcggcgctcggcaaggtcgagcggcacgtggccgatgcggtcgcgaagggcgcgcacacgctcaccggcggcaagcgtcatgggctcggcggcacgttctacgagccgaccgtgctgaccggcatgacggccgacatgctgatcgccgaagaggaaaccttcggccccgtcgccggctgcttccgcttcacgaccgaggaagaggccgtcgccgcggccaacgatacgccgttcgggctgtccgcgtacttctatacgcgcgatctcggccgcgcgtggcgcgtgtcgggtgcgctggaaagcggaatggtcggcgtcaacgacgggatcatctcgaccgaagtcgcgccgttcggcggcgtcaagcaatcggggctcggccgcgagggctcgaagtacggcctcgacgaatacgtggaactcaagtacacgctgatggccggcctcggccgctgaccgctccccgcggtcgacccgcgccgcgcgccgcccggccgcgcggcgccttgcacggcgctcgcggcgcagcgccgcctgcgcgcgccgccgcgccagataacaatccaggaggcagcttgacccaagccgacgttcaatccggcaccgcgcgcgcgttgccgctgtcgcgtggcgccgatgcgccgcaccgccccgtcgcgctcgacgacgtgccgctcaaccgtttccacgtgaagatcgccggcctgacgttcggcgcgcatttcaccgaaggctacacgctcggcacgatcggctacgcgctcgccgcgctcggcaggcagatgccgatcgacgcgttctggatggggatgatcggcagctcggcgctgatcggcatcttcctcggcagcctcgtgttcggctggctgtccgaccggatgggccgccagaagatcttcctgacgagcttcgtgatcatcacggcggccgcgttcgcgcagttcttcgtcacgtcgccgctcgaactgtgcgtactgcgcgtgctgatcggcttcgggatgggcggcgatttcaccgtcggtcacgcgatcctcgccgaattctcgccgcgcaagcatcgcggcacgctgctcggctcgttcagcgtgatctggacgatcggctatgtcgccgcgaacgtgctcggcctcgcgtacggcgacgccacgcccgacgcatggcgctggctgctcgcatcggctgctttgccggcgctgatcgtgctgatcctgcggatcggtacacccgaatcgccgcgctggctgctcggcaagggccgcgtgcaggaagcacgcgcgatcgtcgcgaagcatttcgggccgcacgtgatgctcgacggttcggccgaaccgcatgcgaatgccggcttcgcgcggctgttccagcgtgacctgatccgccgcacgattttcaactgtgcgttcttcgtgtgcctcgtgattccgtatttcgcgatctacacgttcctgccgacgatcctgaagacgatcggcctcgccgaaggcttcggtgcggacctgctgctgaacgcgttcctcgtgctgggcgcgctgatcggcatagggctgacgatccggctgtcgcgacgcggtttcctgatcggctcgttcgcggtgacgtgcgcgtcgctcgtcgcgctcgcggtgctgccgtcggcggcggccgtcgcgatgatcgtcgcgttcgcgatcttcacgctgacaatgtcggcgttcagcaatctcgtcggcgtgttcccgcccgagtgctttccgaccgaagtccgcgcgagcggcgtgggcctcgcgatcgcgtgcagccggctcggttcggcgatcggcacgttcctgctgccggccggcatcgcgacgctcggctttcacgtgacgatgttcgcgctcgcgggcgtgctgctggtggggatgatcgtgtcgatcgcgtgggcgccggagacgaagcatctgacgctggaggaggcgtcggggcattgacgacggaggcgggtggcgtgcccgcctgcttcgtcacgctcggtgctttcgcttcgactcgccgccgatgcgtaccggcggtgccgatcgcgattcgaacgaacccggccgcggccgggttcgcgcattccgggcgcgatgcagtgcgcgcgttcgttcagaacagaatcgacgcgtagtcccgcgcgccgtgcaggatgtgaagaatgtcgatccgcgccggcggatcaccgacgacccgatagaagatctggtagttgccgtacacgcggtgccgcacgccgtgacgctcgaagcgcggcaccagcggaaacgccagcggcatcgcggccagactcatgcacttgtcgcgaatctcctgcacgaacgtcacggcgcgttgcgggttgtcgcgtgcaatgcaatcggcgaccgcttcgagttcgtcaatcgcaaaatcggacaggcgcacgatcaggcctgccgatccgcccgcgcccgatacttcgcctcgagacggtcgaagacttccgccgcctcggcgccgcgtcctgcttccgcatcggccaggctgcgcgcgatcaccgcgtccagcgcattcagttgcgcctcgcgatcctggatcaggcgcacgccttcgcgcaacacttcgctcttggatccgtagcgccccgattcgaccagcttcgcgacgtaagcctccagttgctggcccagttccgcactgatcatgtcgacctcccgaccggattgaattcgatccgccgagcgtaccttggttatcaactattatcaagaagacacgctccggacggaacggcgcgaacacttttcacggccgatcgggtgaatggacggaacgggattcaggcaggctgcggcggtgccggcattcatccgggtttcgccttcactcgtgtagccttgccgaacgcccaccatgcgaacaccgaccatgattgaagacatcgtcacgccacaacccggcctgaaggtctacccgtcggacaccgacgtctttgccgaggccgatgccgcactcgcgcgccatctgcatccgctcgtgtcgatcgacctgtcgacggtcgatccgtcgtggcagggctggatccacctgctcagcccggtcgaaccttatgacgggctcgtggggcaggacacggccgcgtaccacaacgactatcttcgcgcgaactggatcgggttccggctcgacgacaacaaccgctacacgctgctcggcgaccggcgctacttctatctggaaaacccgcccgacccgcgtgacgcaggctatcgcaaggaactggaggcgcattacgccgaacaacaggccagcatcgaagccgcgcgcaagcggttcgccgaatacggcgtgctctactcgtccaaccagtacgcgccggccgagcgcgatttcggccaggaaaagccgtgcaatctcgtcgaccagcttggcggatcggtcggctggggcaactggtcgggcacctcggatttcccggtcgacgacagcgatccggacgacatccggccgatcggccccgacggggcccgctttcgcttcgttgccggcgtgaccggatgggaatatcgcgcggcgggcgccgactggattctcctgttttacgaaccggtcagccgcgtggcgctgctgacgttcgactggtcgtaaggcgggcgggacggcgggcgttccgcctcgtggttggccgttcggcggactcggcgcggcggattcgcggcgataggctggggctttccgcttttcgaccgcaaccatgcccgcccgccttgtcgacctcagtcatgtcctgccgtacgagacgacgtacttcgacgaccggctcgcggtcgaacgaaacggcctcgatatttccgcgttgctgggtgtggacggtcacgttcccgacgcgttgctggtttcgttatgcggagcgccgtccggctccgacgttcaggcctatctcgacagcgccgacaagttgacgtttgccgtcacccatccgacgctgattcgatcggaaaaccggatatcggtattccgaaccgttgacacgcgagtgcttgaactccgtgcaatcgatctggccgacggcgcggtcgccggactcggcgcggcaatgctctggagaatcgttcgagcgtgtgatacgttggacatcgcccggatcagtgccttggcgatgggggccgcaaatcgccgccggaacccggcgggcctcggctccatggatactacgcatggccgaggttcggtttcgatgcgcccattccgggcgcgcatgcggatgaagcagccctgttccagtatttccagggatatccggtcgggttggccgacgggtcgcttcgatccctgcgcacgctctatgcgacccgggtcgggcgagacttctggcgagtcgccggatcacatcggtggatgacattcgacgttacgccgcatggtgcatccgtgctgacactgcaggattacttgatcgagaaggggatttacggatgacgggaaagcacagccgaatcgccggattccagattgcgcagccttcggcggcacgcagtcgcacaacgaacgggaatcgtgtcgtccggcgcgcggaaatgagacggctccttgaggaattcctcgcgcgcgaactccgtcgcagtctcgcgcatacgtccgccgccgtgctggccgcaccgccggccggtgcgtcggcgccgccgccgagagccgtcttcaacgtggggcgcatcgatccgtcgaagtccacgttgcccatcatctcggaggccgaagccaaagctatcgggggccgggaaacgttcatgcacttcggtctggatcccgatctgtacaccgcaacgtgtgacactctctgacagatcggaatgggaggatcggtgcgtgaacgatcgacgcgcgcatcgcaatctccccgtccgcacccctatcccttccaccccacctgctccctcacccacgcggcaaacgcaagcacgtgctcgaccgcgacactctccggctcgacatcgagccaatagccgaacggcccgatcggctgcaccggcgacagccgcacgaggctgccttcagcgatctcctcctcgatcatgttcaggtcgaccaccgcgagccccgccccttgcgcgctgcgcggatcgcctgttcgagcgtggaaaactcgatgccgtcgccgatccgcgccaccggcacgcccgcctgctcgcaccagtcggcccacagcgtcaggcgcttgccttcgtgcagcacatgcagcgacggcagccggccgagcagcacgtcgagcgcatcgccgcgataacgcggcgcaccgacgagcgcatgccgctccatcatcagcagctccgactgcatccccgtgcgcgccgcgcgcccgaagcggatgtggcaatggcaatcgtcggccggctcggtgcggatcgacagctcgacgtcgggcagcgtctccgcgagcgtgccgagccgcggcgaaaaccactgcgtcgcgaacgtcggcggcagcgacaccgtcaggcgccgcttcgcacccggccgcgtggcggcgacttcgtcgacgccgcgctcgatcgtgtcgaacgcctgcccgacgaacggcagcaagcgccggccggcctcggtcaggcgcacgcccttgtgatcgcgctcgaacagccgcgcgccgagcgcttcctcgagcagccggatctgccggctcaccgccccctgggtcacgcacagcgaaaccgccgcacggttgaagctcaggtgacgcgcggtctcctcgaaaaatcgcagcgcgatcaacgatggcaggcgtcgcatgatgtgtgtccccttcgttcgtatcgttcgtatctttagtgtcgttcgtgccgttgccggccgtcaccgccgtccatcccgcgggccgcctgatcgcaaccctgcgcgccagccgccgcgccgtaaaacccgagggcccgcgccctcgctcgcatccattcatcgtccccgcgcccgcgccgcccgcctacaataagcatcccgcaccaaacacgacaccgccccgtgagacgcaagatgccggcgctgaacgcgctgaaagccttcgagatggccggccgcaccggcagcttcacgcgcgcggccgaactgctcaacgtaacgcagagcgcggtgagccgccaggttcgccagctcgagggccagctcggcgaaaccctgctcgagcggcgccatcaccagctcgaactgacggcggccggccgcgtgctgctgcgcgcgctgcagcaatcgttcgacaagatcgagctgaccgtgcgcagcctgcaggaaaaacccacctgaaccgcctgcgcgcgaacgtgccgcccaccttcgccgcgcgctggctgatgccgcggctcggccggctgcgcgacgcgcatcccgaattcgagctgagcctcacgacccgcattcacgacagtctcggcgaatcgcgcgtgctcgactgcgcgatccggttcggcgacggcgaatgggacggcttcgacaacgcactgctgatgcaggagcagcatatcgccgtctgcgcgccggcgctgtatgcgcggctgcgacaggacggcgcgccgatcgacctgaaccgcttcacgctgctgcacgtgctcgccaccgacgaccagcgctacctgacctggcagcactggctgaaggccgccggcatcgccgacgtcgacacgcgcggcggctacgaattcgacctgctcgaccacgcgatccgcgcggcgatcgacggcctcgggatcacgatcgccgatcgccacatggtcgcgcgcgaactggcgaccgggcaactgatgcaggtgctcaacgtgcacgtcgacggccatcagtcgtactggttcgtcacgcggcccgaacagacgaacctgccgcacatcgtccagttccgcgactggctgcagcaggaagtgtggctcgcgaaacgccacctcgaaccgtcgtcgccgcttccgcaagtgccgctggcctagcagcccccgccccgaccgaccgcgaacgccgtcgaccggcacgcgcgggcgacaccttaccggcttccacgcccgtccgcattcggcgccgtctgaaaatgcggcccggccaccgcccggcccggccccggcccccggctcgcgccacggcagccttgccggacgggcgattccggccgacagtccgagtaacgtgcgtttttctcatgcccggcacgaaaataagtcgtttgtcgtgcgctaaacgcatgaagagaatggcctctgtcccgtgccgcgcgtgtcgccacccgaagcgatccgcctgcattcatcggaggagtcacttcatgcgcaccgaacgcaattacgtgaacggccgtttcgtcgccccggaaagcgacgcgttcatcgtcgtccacaatcccgccaccgaagcgccgttcgcgcgcgtgccggccgcgacgccggccgacgcactcgccgccgtcgacgccgcggccgccgcgcagaaggcgtggcgcaagctgccgagcgccgagcgcgccgcgtacctgcaccgcttcgccgacgcgctgaccgcgcgtgcgcccgagatcggcgcggcgctcgcgcaggaatccggcaagagcgtcgaggacgcgtcgaacgaagccgtctacgcgggccagatcacgcgctatcacgccgagtgggcacgccggatcgagggcgagatcatcccgagcgatacgcccgacgagaacctgttcctgcagcgcgagccgatcggcgtcgtcgcgtgcctgatcccgttcaactatcccgtctacacgctgctgcgcaaggtcgcgcccgcgctgatcgccggcaacaccgtggtcgtgcggccgagcaaccacacgccggtatccgcgttcgagatcgcgaaggcggccgacgatgcgggcttcccgccgggcgtcgtcaacctcctgacgatggatcacgcgacggccgaagcgctgtgcacgcacccggcagtcgggatgatcacgctgaccggcagcgtgaacgcgggccgcaaggtgctcgattactgcaaggcgaacatcgcgaagccgtcgctcgaactcggcggcaagacgcccgcgatcatcgagcccgacgccgatctcgaacgcgcggccgccgcgctcgtcgcgtcgaagacgacccattgcggccagctctgcacggcgatcgagcgcgtgtatgtacacgacagcgtgcacgaccgtttcgtcgcactgctgaaggagaagatggcggccgtgcgcatcggcgaccgtgcggaagacgccacgcggatgggcccgctcgtcagcgcatcggcacgcgcgcacatccacgggatggtcgaacgcgcgatcgcggcaggcgcgacgctcgaaaccggcggcgcgatccccgacggccccggcttcttctacccggccacgctgctcaccggcgtgcggcaggacatggagatcgtgcaggaggagaccttcggcccgatcatgccggtgctgcgctacgcgacgatcgacgaagcgatcgcgcaggcgaacgaccaccagttcggcctgtcgtcggtgctctacaccgagcgctaccgcaccgcgatgaccgtcgcgaacgcgatcgaagccggcgagctgtatgtgaaccgcacgccggccgatccgtaccagggcttccatgccggctggaaacgttcgggcctcggcggcgacgacggcaagcacgggatgctcgaattcacgcagacgcgcctcgtcgtcatgaagtactgacaccgcgatacccacgcaccgtttccggcgcgcgcaccaacgcaccacgccgcgcgccgccctgacccgaccagaccataaaaactgcaggcgtccgcctcgaggacgcctgatggaggaagacatcatgccgacccaaccgtcgacgcccgccgcgtcgctcgcgttgcacgacgacgctcacgcgtcgcagcattcccgtgcgcaacgctacctgcaactgctgctgctcgtgattgccgcgggcgcgatctatccgatgctgtatctgcggcaggtgtaccagccgacgatgctgcagttcttccatatcgacgacgtgcagctcggctacctgtattcgtcgctcggcacgatcttcctcgtcagctacctgccgagcggctggctcgccgaccgcctgtcgccgcgctggctgatctgcttctcgctgctcgcgacgggcgcgctcgggctcgcctacgcgaccgggccgtcgttcgacacgctcgtgctgatcttcggcggctggggctgaccaccggcctcacgttctgggccgccgtgatcaagcgcgtgaacatgatcgcgggcccggacgaacagggccgcttcttcgggctgctcgacggcggccgcgggctcgtcgaggcgctgctcgcgacgatcgcgatcacgctgttcgcctacgtgacgcaggcgcacggcggcaccgacgcggccggcttcaggctcgtcgtgcacctgtacgcgttcttctgcatcgcgctcggcgtgctgctcgcgctggtgaaggatccggcgggcgcgagcgaccgtgcggccgccgcacagcgccgcaccggcagcgaccgccagggcaacgtgctgaccgacctgaagacgctcgcggcgatccccgagctgtggctcgtcgccgcgatcgtgttctgcggctaccaggtgttctgggcgacctacagcttctcggcctatctgcacgaaggcaatttcgggctcagcgcgacggcggccggcttcatcacgacgctcaagctgtggatgcgcccgatcggcggcatcggcggcggcttcctcggcgaccgcgtatcgaaggtgtcggtgctgttctgggcgctgctgctcgccgcgctgtcgctcgtcggcctgatcgccgcgcccgcgcacagcccgcaggcgatgctcgtcgtgctcgtgctgttcatcggcatcctcacctacgcgatccgcggcctgtactggtcgctgctcgacgactgcaaggtgccgacgcattgcgccggcctcgcgatcggcctgatctcggtgctcggctattcgcccgacgtgttcgtgccgctgatcaacggctacgtgacgcagaccttcccgggcgcgcacggctaccagctctatttcggctatatcgcggccatcgcgctctgcggcgcgggcgcggccgccttcctcaaataccgtctcacccgcattcaccgaatccaggagtccgcatgaagatcgtttcgctcgaaacccatatcgtcgccgtgccgccgccgcatgtcggcgggatgtactggatcttcgtgaagctgaagaccgacgacggcatcgaaggcgtcggcgagatctattcggcgacgttcggcccgaaggcaatggccccgatcatcgacgacgtgttcgaacgccacctgctgaaccgcgacccgcatcacgtcgaacggctgttccgccaggcctattcgagcggcttcacgcagcgaccggacctcacgatgatgggcgtcgtcagcggcctcgaaatggcgtgctgggacatcatcggcaaggccgccggcaagcccgtgtacgaactgctcggcgggcagatccacgagcggctgcgctcgtacacgtacctgtacccgaagaacgcgaaaggcgaatacgactacgacgattccgatctcgcggccgaatgcgcggccgagaacgtaaagctcggcttcaccgccgtgaagttcgacccggccggcccgtacacggcctactcgggccaccagctgtcgctggacgtgctcgaccgctgcgagacgttctgccgcaaggtgcgcgaagccgtcggcagcaaggccgacctgctgttcggcacgcacgggcagatggtgccgtcgtcggcgatccggctcgcgaagcggctcgagaagtacgacccgctgtggttcgaggagccggttccccggccaggaagaagcgatcgcgcaggtcgcgaagcacacgtcgatcccgatcgcgaccggcgagcgcctgaccaccaagtacgagttccacaagctgctgcaggcgggcggcgcgtcgatcctgcagctgaacgtcgcgcgcgtgggcggcctgctcgaagcgaagaagatcgcgacgctcgccgaagtgcactacgcgcagatcgcaccgcacctgtacaacgggccggtgggcgccgccgcgagcatccagctcgcgacctgcacgccgaacttcctgatccaggaaagcatcatgacgtggggcggtttccatgccgaagtcgtgaagacgccgatccgctgggaggacggctacatcatcccgtccaacgagccgggcctcggcatcgagctcgacatggacgtcgtgcggcgccacacgccgtacacgggcgaacggctgcacctgcagatgggcgaacaccccgtcgacgtgaaggatctcgcccccgcgaagggctgagcgcaaaggacagacatgagctacgactacatcatcgtcggcgcgggctcggccggctgcatcctcgcgaaccgcctgagcgaatcgggccggcactcggtgctgctgctcgaggcgggcgaacgcgacgcgtcgttctggttcaaggtgccggtcggcttcacgaagacctactacaaccgccgctacaactggatgtactacagcgagcccgaagcgcagctcgccgatcgcaagctgtactgcccgcgcggcaaggtggtcggcgggtcgggctcgatcaacgcgatggtctacgtgcgcggccagcgcagcgactacgacgactgggcggccgccggcaatccgggctgggcgtacgacgacgtgctgccgtacttccgcaagctcgaaacccacgcggccggcacgaccgatccgcagcatcacggcgcgacggggccgattcacatcacgtcgatgaaggccgacgtgcatccgatcgtccacgagttcctgaagggctgcggcgaactgaacctgccgcgcaccgacgacttcaacggcgcgcagttcgaaggcgcgggcatctacgacctgaacacaaagaacggcgaacgctgctccagcagcttcgcgtacctgcgtcccgcgctgggcggcgcgaacctcacgctgcgcgctggcgtgctcgtgcggcgcgtgaccttcgacggcacgcgcgccaccggcgtggtcgtctcaggcgcgcacggcgacgaaacgctcgtcgccgtgcgcgaggtgatcctcgcggccggcgcggtcgatacgccgaagctgctgcagctgtcgggcgtcggcgatccggcgctgctcgcgcgccggcgcgtgccgctcgtgcatgcgctgccggccgtcggccgcaacctgcaggaccacctgtgcgtgagcttctacttcaaggcgaaccggccgacgctgaacgacgagatgggcacgctgctcggcaagatgaagatcgggctgcgctacctgctgacgaagcgcgggccgctcgcgatgagcgtgaaccaggccggcggcttcttccgcggcacggacgatgcgcaggaaccgaacctccagctctacttcaacccgctgtcgtaccggattccgaagagcgaccgcgcgagcatcaagcccgagccttattctggcttcctgatcgcgttcaacccgtgccggccgacgagccgcggcacgatcgagatcgcgtcgaaccgcgcggaagatgccgcgaagatccacgtcaacgcgctcaccacgcgcaaggatctcgacgaagccgtgcagggcagcaaggtgatccgtgcgctgatgcgggcaccggcgctgaagtcgatgaccgtcgaggaaatctcgccggggccgcaggtcgattccgacgaagcgatgctgcagtatttccgcgagcagtcgggttcgatctaccacctgtgcggctcgtgcgcgatggggccggacgcggcgacgtcggtggtcgatgcgtcgttgcgcgtgcacgggctgcaggcgctgcggatcgtcgatgcgtcggtgttcccgaacatcacgtcgggcaacatcaacgcgccgacgatgatggtcgcggaaaagggcgcggatctgatcctggcggatgcggggcacggcgaagcgtctgccgtgagcgcaagcgaacgggaaacggtcacgcattgaggcggctgcgctttcgccgattgccgttccggcaatcggcttcgcgatgcaacgcgatgcaacgtcagcgccgcgactatgcgcaataggacaacacgatcaacggatcccccttccttcgttgctcgccaattgatgaacgcgctgcccccaaggccggctcgccagcatcgaacaggtcacacccgcccgggccgatcccgcagatcgccggcacgtcgcagcgtgccgcatcccgtccttcgagtcacattcaatccccgcactgccccgcgcctccacctcgtcgaacacccgcacgatgtgatcgatcatcgcgctcattcgcgcggtatgccgcagatccttgtgcgtgaccatccagacttcatagggccgcgccgacgtgcgtgccggccacacgcgcaccagcccgtcgcgctccgcgatcggcaccgggagttcggcgagcccgagcccggcgcgcgcggccgcgcgcagcatgagattcgaattcagccccgacacgatccgccccgcgcgcaccggctcgccgaccaccgtcagcgggctgcgcgcattcaggtgcggcaggaagcacacgaggtcgtgcccttcgaagccggtgccgggcgtcggctcgccatgccgcgcgagatagtcctctgacgcgtacaacgccgtcggccatgccgcgagccggcgcatgagcagatcgggattgtcgggcttgatcgtgcggatcgcgatgtccgcctcgcgcttggccaggttctccacctgcgtcgacgtgttgagcagcacgcgcacgtccggatgctcgtcgtgcaggttgcgcatcgcgcgcatcacgaattcgagcccgatcgtatcggtcgtcgtcacgcgcacgtcgccggcgaggcgccggtcgacgccctgggtctgccgcaccagatcgatcgccgactgttccatcttctccacgttgcgcagcgccacctcgcccaccgcggtcggcacgtacccggccgacgtgcgcaggaacagcgtcgccccgagcgcgcgctcgagcgccgcgagccgcctgccgaccgtcgcctggtcgagcccgaccgcccgcgcggcgccgcgcaggctgcgttcacggtggatcgcgagaaaatccgtgcgtcgtcccagttcaagcgccttctcccggtgtgatgcaaatttgcatctgtggtcgtgaaaatcgctgcgcgaattcatcaaggcccaagcctatactttttcaccgatcactcacctgtctttccgaggcaaacatgtccgaaacgctctccccgttcccgccgacatggcggcagtcgaaatcacccgccccggcggccccgaagtcctcgcgaccgcacgtcgccccgtgccgcggccgaaagccgacgaagtgctgatccgggttcacgccgccggcgtgaacggcccggacgtgctgcaacgcaagggctctacaacccgccgcccggcgcatccgacatcgggcctggaaatcgcgggcgaagtcgtcgcgaccggcgaagccgtgcgcgacttcgcgccgggcgaccgggtcagcgcgctggtgacgggcggcggttatgcggaatacgcggtcgcccatcacctcacgacgatgaagctgccgcccggcctcgacatgatcgaagccgcggcgatgccggaaacgttcctgacggtctggctgaacctggtccagcgcgggcggctgcaggcgggcgaatcggtgctgatccacggcggcgcgtcgggcatcggcaccaccgcgacgatgatcgccaaggcgatgggcgcgtcgaccgtcatcacgacggtcggctcggaagcgcatcgcgccgcgagcctgcgcctcggcgcggatcatgcggtgcattaccaggaagaagatttcgtggccgaagtcgacaggatcactgccggcaagggcgtggacgtgatcctcgacatcatcgcgggcgactacgtcgcgcgcaattaccgcgccgcggcgatgaacgggcggatcctgcaggtcagcgcgctcgccgggccggcgaaggaactcgacgtgtggccgatgatgaccaagcgcctcacgcacatcggttcgacgctgcgctcgcgcacgccggaggagaaaggcgcactcatcgccgaactcgaacggcaactgtggccgcacgtcgcggcgggcacggtcaagccgcaggtgttccgcaccttcgcgctcgacgacgcgcgcggcgcgcacgtactgatcgactcgggcgagcacgtcggcaagatcgtgctgacgacggccgcgcaccgcgcggcctgaccgggcaagacgcgtcagttcacgctcgtgcgcttctcgacgaaccgcttcacgtaatcgtccgccggacgcgacaggatgtcgtccggcgtgccgacctgcacgagcgcgccgtcacgcaggatcgcgatccggtcgccgatgcgcagcgcctcgtcgagatcgtgcgtgatgaacacgatcgtcttcgcaagcgtcgcctggttcgagcagctgatcctgcatctcggtgcggatcagcggatcgagcgcggagaacgcctcgtccatcagcagcacgtcggtatcggccgccagcgcgcgcgccagcccgacacgctgccgcatcccgcccgacagctcgtccgggtaatgatcgccatacccgtcgagcccgaccttcgtcagccagttgcgcgcggcgtcagccgcgtcgtgccgcttctcgccgcgcgtgcgcagcgcatacgcggcgttgtcgagcacggtctggtgcggcagcagcccgaagttctggaacaccatgctgaccttgtagcggcgcagctcgcgcagcccgtgcgcgtcgagcttgatcacgtcgctgccgtcgatcacgatctcgccggccgtcggctcgatcagccggttgaagtgccgcacgagcgtcgatttcccggaacccgacagccccatgatcacgaagatctcgcccgactcgatgccgaggctcacgtcgttgagcccgacgttgcagcccgtttcggccagcacgtcggccttgcgcctgcccgaacgcagcaggtcgagcacgcgcgcatgcgcggcctgcggcccgaacagcttgtacgtgtttgacgtcgatggtcgccatgtctgcctccgttcctatgcgcgcgacgattgcgtcgcctgattcgaatcgacgcccgccggctgcgccttgcgcggcagccggtacggcacgcgcgacgcgcccttctgccggcgctgctgcgcgagccggcgcgcgcgcgctcctggccgaagccctggctgatccggtcgatcacgatcgcgaggatcacgatcgcgaggccggcctgcgtgcccttgccgacgtcgagcgtctggatgcccgcgagcacgtcctcgccgagcccgcgcgagccgatcatcgacgcgatcacgaccatcgacagcgccatcatcgtcgtctggttgatgccggccatgatgctcggccgcgcgagcggcaactgcacgttgacgagcaactgccagcgcgtcgtgccgaacgcacgcgcggcctccgtcacgtccggatcgacctggcggatgccgagatcggtcaggcggatcagcggcggcagcgcatagatgatcgtcgcgagaatcgcaggcaccttgccgagcccgaacagcatcagcaccgggatcaggtacacgaagctcggcagcgtctgcatcacgtcgagcacgggcagcagcatccgccgcagccacgcgctgcgcgatgcgaggatgccggccggcacgccgatcgcgaccgacagcaccgtcgcgacgagcatcagcgcgagcgtctgcatcagcttgtcccacaggccgaagcagccgatcgcgtagagcagcagcacgaaaagcgcgccgaggccgatgcggcgcgtcgcattccacgcgatcgcgccgacgaccagcagcacgagccacggcggcgccacgcgcagcgcgccttcgagcggcacgagcaggtagcgcaacacgagcacgctgaagtgatggaagctgtcgccgtattgcgcgacgaacgtctcgagcacgctgttcacccagtcggcgatcgacaggtgcagaaagaagccgttcatgttgattctccgtcgcgccgcgaaggcgcgtgacggcggcggcgggcgcgggcccgccgccgcgcgcaggttacgcgcccttcaggctgccggcgatcttctgcgcgacgtcggccggcacccattgcttccacatgtcctggcgggtcttcaggaactgcgtggccatcgccgcgccgtcgatcttcttcgtcgtcatctcgaggatcgtctggttcaggaagtccatcgggaaacgcaccttgccgaatacgccgacgagatcgggattcgcgtcggcgaacggcttcgacacgccgaccgtcagccgcgacaccatgtacgacgacgcgcactggtgcgtgctgctctcgtcgcgcagcgtcttccagcatgcctcgttataggccggcatcttcagcgcggtgaatttgtacttcgccatcagtgcggccgggccccagtaatagaacacgatcggcgcgccgcgctggtacgcggacgcgatcgccgcgtcgagcgccgcgccggtgcccggatggaagttcgtgtacgactggtcgagcttcagcaccttcagcagacgcgtgttcacacgctcgcagtcccagcccgtcgggcagttcaggaagcggcccttgtccggttcctcctcgtcggcgaacacctgtctgaacttcggcagatcgtcgaccgacacgagcccgggcgcgaccggcttgatgtggcgcgccggatcgcccttcaccacgtagtcgggcacgaaccagccttcggtcgtgccgcccggcagcgtgtcgccgatcagcttcacggcgcccgacgagacagccttcgcggtgatctcgctgcggcccgtccactgctcggcccagatctgcaggtcgttgcgcgcgagcgccgtttcggtggcggccgtgctgcccggcacgacgtccgtcttgcagccgtaacccttctccatgatctgccgcagcacttcggtcgcgaacgacccgctctcccacgtgatgcccgcgaaatggaccgtcttgccgtcggcgcacgcgccgccggccgcgtgggccgcgggcgcggacaggatcgccgcggcggcgagaaggaccgttttcagtcgtcgaatctgcatggtgggtcgtctccaaatcgaatctgttgtttgtgcgtcgcggcatgcgcggcgaccggcgaatcgtgcatccggccacgtccggtcagcctgcatgtttcagccgccaatatgtttagggaaacgagtaattccgatcatggctatcggcagcgccaatcgatctccgggcgccccgccaggcccgcccggcgggcctcccggccgatctcccgcgcctgcgcacggccccggccaggctgcgtcgcgccccgtccggcgagggcgcgaccggcgttggcgcgcgccgccgcgcacacggtttcgactgtcgaaacggccggtcgcgaccccatcggcgaacccgatcccatccatcgaaattactcgcttccggttcgtcttcggcttgggaagaatgcgcggtgtcatcggaggagacacgacccggcacagccggtcgccgcgccgccgcgcatcgcgcgtttccggcgccgcgcgctgcgccggaaacgccccggatgacgggcgcgcctcgccggtcgcgcccacgacaaccgatacaagaagctggatatcccggagatctctcaatgaaaaagaccctgacggcgctcgccgtaacggcaaccttcgccgcccccgtgttcgcgcagagcagcgtcacgctgtacggcgtgatcgacgaaggcctgaactacacgaacaacgtcggcaccggccacgtctacgagatggcaagcggctacgcgcagggcagccgctggggcctgaagggcagcgaggacctgggcggcggcatgaaggcgatcttccagctcgaaaacggcttcgacgtgaactccggccggctcaaccagggcggccgcatgttcggccgccaggcgtacgtcggcctgagccagacgcagtacggcacgctgacgttcggccgccagtacgactccgtcgtcgactatctcgcgccgaccacggccaacggcaactggggcggctacctgctcgcgcacccgttcgacaacgacaacaccgacaactcgttccgcctcgacaacacggtgaagtacgcgagcccgaacttcggcggcttccagttcggcggcgcatacagcttcagcaacagcacgagcttctcggacaaccgcgcgtacagcttcggcgcgcaataccagaacaacggcctgctgatcggcgccgcgtacctgcaggcgaaccgcccgggcaacggctcggccggcgcgatcaccgcgaacgacgcgagctacatcgcggagcgcatgcgcgtgttcggcgcgggcatcaactacacgttcgggcccgcgacgctcggcttcgcgtacacgaactcgaactacaagaacccgaccggcaacggctacctcggcacgccgggcgcgatcatcgcaccgggcgcgacggtcagcgcgatcaagtaccagaacttcgaggtgaacggttcgtaccagatcacgccggcgttcatggtcggcgcgcagtacgtgctgtcgctcgagaagtacgacgcgtcgaccggcgacgcgaaaccgaagatccactcggtcgggctgatggccgactacaacctgtcgaagcgcaccgacgtgtacgtgcaggccgcgtaccagcacatcgccggcgacaagacgaactcgatcctcgacaacgcgttcatccccggcaccgacgcgccgtcgtcgacgtcgaaccaggtggccgtgcgtctcgcgctgcgccacaagttctgacgcaacccggttctccgttcttcacgcgacacccgcgccggtcggcccgaggtgtcttcgcccgcccgcacgcgccagcctgccggcgggtttttcatgcgcgctgcaacgcgcgtgaccggccgatgacgccggaacgggcaacgggcgcgcaatcgtcccgtcaaccgtgacaggtcaacggacgacgatccgtcgatacactatgggcctgcgcaacggccggcatccccgccttcctcgatgccggccgtcgccttcattacgcacggcccgccgcctttcgcccgcgccgtgcgcctgccgcccccaaggagtgtcacttgaagcactgtcgccgcgcgctgttcaccctcgccgccggccttctggccagcgcgacttcccatgcccgccccgtctgcaccgtcgtcgccgacgccgccaccggccaggtgctcgtgcagcaaggcgactgcgcgacccgcgtcacgcccgcgtcgacgttcaagatcgccatcagcctgatgggcttcgatgcgggcgtcctgaaggacgcgcacacaccgacgctcgagttccacaccggctatcccgactggggcggcgcgccgtggcgcgagccgaccgatccggcgcgctggatgaagctgtcggtgttctggtactcgcagcaggtcacccaggcgctcgggcaggcgcgcttccagcaatacacgaccgcattcggctacggcaacgcggacgccaccagtcaggtgggtgaactgaacggcgtgatgggcgcatgggtcaacgcgtcgctgcgcatttcgccgctcgaacaggtcggcttcatgcgcaagatcgcgaaccggacgctgcccgtcagcgcgcacgcgtacgacatgaccgagcgcatcacgctgatcgacacgcagcccggcggctggatcgtgcacggcaagacgggcaccgggtcgccggggcgcaagtacgacgcgtcgcatgcgtacggctggttcgtcggctgggcggccaaagggccgcgcacgctcgcgttcgcgtacctgatacaggacgacgagcggcagacgccgaacgccggcctgcgcgcacgcgacacgttcctggcgacgctgcccgccctcgccgaaccgggcaggccgcaatgagcgccggcccgcgcaacgcgcggatcgacctgctgcgcggcgtgtcgatcgtgctcgtcctgctgcatcacttcaacatcccctactcgctgcgtgagacgtcgctcgcgcgcgtattcggctgggaaacggtgcatgcggtggtgcgcaacggcaactacggcgtgacgatgttcttcgcgatctcgggctacctgatcacgtcgaatgcgcggcaccgctggggcaacctcggcgcggtcgacgtgcgcgcgttctacgtgtcgcgcatcgcgcgcatcgtcccgtgcctgctcctgctgctcgcgctcgtcaacggcctcgcggcggccggcgtgccgatcttccggaaccacgcgccggagggcgtcgccgtgtcgttctggctcgtgaatctcgcgtcgctgacgttctggatgaacgtgctgatcggcgcatacgggtgggtcaactacgcgctcggcgtgctgtggtcgctgtcggtcgaagaggtgttctacctgtcgtttccgctgctgtgcatcgcgctgcgccgcgatgcgcggctggtcgcgttctgggtggccgtcgccgcgatcgggcccgtgtaccgcttcacgcacgccggcgacgaaggcgggttcctctatgcgtacttcgcgtcgttcgacgggatcgcgatcggctgctgcaccgcgttgctggccgagcgcaaagctggcagcggctcgccgcgccgctcgtgcaggggcccgtcgcggcggcgatggccgcgctgtatctggcctggccgatcgcggaaagccacgtcgccggcgtcaccgcgatggcgctcggcacggccgtgctgctgatcggcgcgcacgtcaacggcacgcgcgcgcagggccgcctgctcgcgccgttgcgccgggccggcacgctgagctacgagctgtacctgtttcacctgatcgtgctcggcgggctgcgcacgttctggccgccgtcggccacgcatggcgacacccggctgctgttgctgatcgcgtatctggcgttgtcggcggtgctgagcgcggcgatcgcgcgcggctatgcgacaccgctcgaccgcttcatcaagcgggtcgcgtcgcggccgtcaacgcgcgtgccggacggcgcgcggttctagcggatcgtcggccgcccctgccgggcgacacgacttcggaaagagaagaaagcggccagcgcccggcctgaccgcaagccccgcgtacgcatcgtacgatcgaccgggcgaccgaagccgtcgggtgatcggtagcgtgtcgccgcccgccgatcaatccagatagtcggcgtattccttgcgcgcgtagcgggcgagcgtcgtccacggcggcggctcgcgccgcgcggccggcgccggtgtcaacgtcagcttgcgcacgacgcggccgtcggcactccggtattcgaccgacagcggcgcctgcagcgtctcgctccacaggatccggttcacgccgcgcgcgccgggcgtgtcgaccgcctgctcgtaccagagggtgccgggcgcgtcgccgcgcttcgcgaccgcgagccgcttcagctgcgacggcggcgtgacgtagtacgcgttgtcccacgagccgtcgaagcccgtggtttcgtactcggccggcggcacgctgacgaccgtccggttcgccgcatcgacgtactcgatgcgggccgtcttgccgtcgtaagtcacatgccgtgcagccgcctggaagttgaaatgcttgtggcccgcgtgggcagccgccggctgcacgccggcgcggcggcccgggcctgcatcgtggtcatgatcgtgatcgtcgccctgaccgccgccggccgccgcggcgggcagcacgcgttcgacccacgtgcccgtcgcgccgcaccatccgttcgcgatacagcgtcgtgcgcgtcacgccgtcggccgtcaccgtgcggctctcgtgcagcagcacggcgtcgagatcggccgctgcacacgccggcagtgcaatcatcccgcaggcgagcgcacataggatccggcgtttcatcgtgcgttcctgtttatcgtgccatcacccgcctcagaacccgaacgccgagcgcacgagaccgaacaccttcgtgttgtcgatcgtgcccttgaacgccttcgcatcggcgccgtcggcgaacagcatcacgtcgccgccgccgtgcgtttccgaacccgcgctgcccatccgcacgccgacttcctgcagatacgcatcgttcgtcgcggtggccgaatcgaccgacgcgcgcacgttcggccggttcgcgccgttgccgaacaccagcgtcgtgtaggtattgccgtcggcgtccttgctcggctggccgtcgcgatagttgcggctgatgtcgagaatcgggttgccgcgcttcgaatagccgttgatcgtcatcgtgtggtcgtggtcggccgtcacgacgatcagcgtgttcgacaggtcgaccttcgacagcgcgacgcggatcgcttcgtcgaatgccgccgtgtcctcgagcgcgcgcttcgcgttggtgccgtgcagcgcgtgatcgatccggccgccttcgaccatcaggaaatagccgttcgaattcttcgacagcacgtcgatcgccttcgacgtcatctcggcaaggctcggctgcgacggcccttcgcccttgcccgcgacgcggtccagttcgtactctagatggctcgtcgaactgaacaggccgaccagcttgccgttgccggcctgcgcgagctgatccttcgtcgcgacgaccgtgtagcccttcgccttcatctcgttgagcaggttgcgcccgtccgcgcggccgcgcttgttggccaccggatcgaacggcgtccagtggttgcggccgccgcccatcagcacgtcgacgccgtcgccgagcgccgcgttgtagcccgcgccgcccggcgccgcctgcgcggcgatatcgtattgcgcgtcgcgatggcagatgtgcgaataggtcgcggcaggcgtcgcgtgcgtgagctcggtcgtcgtgatcgcgccgaccgccttgccgcgcgccttcgccagctccagcagcgtcgcgaccggctggccgttgcccggcgcgcagttgttgaccgtcttgttgccgttcgcgtcgctgcccggtgcaaccgcgcgcgtgtcggacgacatcgacagcacttcgttgttcatcttcacgccggtcatgtacgcggccatcgacggcgcgctgtcggtcgtctgcgcgtcgttcgagaaggtcttgatgcgcgcggtgcgcgccagcttctccatcgtcagttgtcccgactcaccgaccttgtagatccggctcgccgtcacggtcgtcggccccataccgtcgccgagaaagaaaatcacgttcttcgcctggccggcggcctgcgccgcgccgcatgcgaaacccgcgacggccagcgccgccgcgatgcacttgatggtcgacatcctgtattcccctgtacccgtatggtcggtgctcacagctgcaccgcgttgcgcaccagctcgaaaaccttgttgttctcgatcacgccgtggaacgcatccgcgccgcggccgatcgcaccgaggaacacatcggtgccgccgtgcgtctcgttgcccttgtccattcgcacgaccgcctcctggcgatagtcgtcggcgcccgtcaccgcgtcggtgagcgcggtgcccgcgcggctgccctgcacgcggttctcgccgttgccgaagccgatgatcgtgtacggcgcgccgtccgcgtccttcgcgaccgcgcccgtctggtagttgcgcagcacgcccagcacgccggccttgcccgcctcggtcttgccggtgcgcgccgcataaccgttcagcaccagcgtgtggtcgtggtcggccgtgacgacgatcagcgtgttcttcagatcgggatcggtcttgcgcaccttgtcgagcgtggccttgatcgcgttgtcgaacgcgaccgtgtcctgcaacgcgcgcttcgcattggtgtcgtgcagcgcgtggtcgatccggccgccttcgaccatcaggaaataaccgttcggattcttctgcagcacgtcgagcgcacgcgtcgccatgtcggtgaggctcggctccttcgtcgcgccgcgatcgaggtcgtagctcatgtggctcgacgagaacaggccgaccagcttgccgctcttcgtcgcatcggcggccagcaggtcgtcgcggttctgcgcgaacgcataacccttcgccttcagctcgttgacgaggttgcggccgtcggtgcgcttgccgccgccgtccttcggcacgaagaattgcgtgccgccgccgagcacgacgtcgacgccgtcgcccagcgcgccgttgtagcccgcgccgcccggcacgagctgcgccgcgatgtcgttctcggcgtcgcgatggcacacgtgcgcatacgtcgcggcgggtgtggcgtgcgtgacgcgcgtggtcgtcacgacgccggtggccagccccttcgccttcgcgatctccagcagcgtcgtcgccgatttgccgttgttcgcgccgcaattgccggtcaggctcgcgctcggctcgatcgccttcgtgtcgggcgacatcgagatcacttcgttgttggtcttcacgccggtcatgtacgccgacatcgacggcgcgctgtccgtcacctgcgcatcgttcgaataggtcttcacgaacgcggtttccggcagcgtatcgatcgtgagcgcgccgtcttcaccgacgccgtagatgcgtgcggccgtcagcgtcgtcatccccatgccgtcgccgaggaagaagatcacgttgcgcgcggccgtctgaacgggcggctgggtgggcgacgtgctggtcgggccgtcgtcgctgccgcatccggcgagcgcaaaggcgcccgcgcacagcagcgccgccgttttgattcgattcatggtgccggttctccccgccgttgatgctttcgaaatgaaaggcgatggtaggaaccggatgtgacgtcaatgtgaatggaaactggaagacatcgaatggattatgaaaggcgacggcgaggcgccacggccgggcgccgcgcgtgttgcggcgtcattccgcgtgttcgacggcgatgttgcgcacggtcacgatgcgcgcaggcggaatgttcgcccagacgatccggctgccgcaggcgacaaatgccggatcgcccagcggatgccgcccgggcggccgcaggtcgtacgtgaactggatcatcacgccgtcggccgacagcacgcgatggcactggccgacgatcgccgtcacgtcctggcgcggcagcgtgcgcagcggcaggcacgacacgatcgcgtcgacgcgcgcgtcgggcggcaacaggcgttcgagctgccgcgcgtcgcccgacacgatcgagatacccggaaaacgtcgccgcagatgctggacgaacgccggcgaacgctcgaccacgacgagccgccgcggcgcgacgccgcgttcgagcaaggccgcggtgatcgcgccggtgccgccgccgagttcgacgaccagcccgtcgccgtccggcaccgcgtcggccatctcgcgcgccagttgccgcgaactcgggcacaacgcgcccaccgcggccggacggccgacccactcgcgcacgaacagtgccgagacacgccacgcgttcggccagatcatgggcagcccttgagcgattgcgccgtcggcaacgacgcgccgaagacatcatgaaacagggctacggcgacacggagcttcggcatgcgcatcctcctggacgaatcggtccgtcgcgggaagcgcgacgatcaaatcgattctaggaaacgcaaacttaaggcgacgtgaagattgaccctgattcccctgatcaattcgtaccggatcaaccgccgacgcccgcccgtgcacggcgcgtctcaccgcaggttggttctcgccagctcgacgatctcgtcgccgcgcccgctgaggatcgcgcgcagcatgaacaggctgaagcccttcgcatgcgcgagttcgatcttcggcggcatcgcgagctcgtacttcgacgtgacgacgtcgacgacggccggcccgtcatgcgcgaacgccgtgcgcagcgcttcctcgacgttctccgagtgctcgacccgcacgctgaagatgcccgcacccttcgcgatcgccgcgaaatcggtcgggctcaggtcgacgttcgtatccagatagccggccgccttcagctccatcgacacgaagccgagcaggctgttgttgtacacgacgatcttgaccggcagcttgagctggcgtgcggtgagcaggtcgccgagcagcatcgacagcccgccgtcgccggacagcgacaccacctgccgccccggatgcgcgccctgcgcaccgagcgcctgcggcatcgcattcgccatcgagccgtgattgaacgaaccgtgcagttgccgcttgccgttcatcgtcaggtagcgcgcggcccacagcgtcggcgtgccgacgtcggccgtgaagatcgcgtcctccgctgcgacttcgtcgacgatcttcgtcaggtattgcggatgaatcgcgcggcccggcggctcggccaccgcgagatcgtcgagccccttgcgcgcggccgcgtagtgcttcagcgcattctcgaggaaacgccgctgcgtcttgcgcgtcaggcgcggcagcagcgccgcgatcgtttccttcacggtgccgacgaggccgagcgcgagcggtgcacgatggccgagctgcgagcctttccagtcgatctgcgcgatcttcgcgttcgacggatagaacggccggtacggaaaatccgtgccgagcatcagcagcgtgtcgcacgattccatcgcgtgatagcccgagctgaagccgatcagccccgtcatcccgacgtcgaacgggttgtcccattcgacgaactgcttgccgcgcagcgcatgcacgaccggcgcgccgagcgtgtcggccagcgcgaccacctcgtcgtgcgcgccctgcgtgccgctgccgcacagcagcgtgaccgcgtcggacgcgttgagcagcgccgcgagccggtcgagatcggcgtcggccggcaggatcgacggcggcgccgattcgctccaggccggcgcttcgtccgggccgtcgcccagcgcgatgtcgcccggcagcacgatcaccgcgacgccgcgctcgtcgatcgcggtgcgcatcgcgcgcgcgagcacgcgcgggaactgcgatgcgttcgtcacgagttccgcgaagtggctgcactcgcggaacagctcctgcggatgcgtttcctggaagtagccgaggccgatctcggtcgacgggatatgcgcggcgatcgcgagcaccggctgatgattgcggtggcagtcgtagaggccgttgatcaggtgcaggttgccggggccgcaactgcccgcacacaccgcgagccgcccggtcgacgcggcatccgcgccggccgcgaacgcggcgctttcctcgtgccgcgtatgcatccagcgaatcgagccgatctggctcaagctgaacgacaggccgttcaggctgtcgcccgtcacgccccagatacgctcgacgcccgctgccgccagcgtcttcgccaggtattccgccatcgtctgtctagccatcatgccctcgctcgttgatcggtcgtcacacgattgatccggcaacggcagccgccgttgccgctgacggacgagcatacgcgatcgtgccgcgcggcgtcgtgacgatgcaagcgccctgcacgccgctgcggcagcgatccgtcgcgccgcacgccgccccttcgacggcgtcgggcaatcgtcggcgctttgtcatggttccgattgcagtcggcagtcggaaaccgcgcaggggcgcctgcggctccccgctcagctccagtcggatgccgcctcgtccgaatcgacgagcgtcagtccggacgccggcaacggcagcgcggtcttgtagcgcacctgcttcagcgcgaagctcgaccggatgttcgatacgccggggatcgtcgtcagtcgctcgatgatgaaacgctcgagcgtgcgcatgtcgggcatcacgacgcgcagcaggtagtcggcgtcgcccgacatcaggtagcactccatcacctcgggccgctgcgagatcgcttcctcgaagcgctgcagcgcgtcctcgacctgcttctcgaggctgacctggatgaacacgttgatccgcagcccgagcggctcggggtcgagcagcgtgacctgctgccggaacagcccgagcttctccagcgcgcgcacgcggttgaagcacggcgtggccgacaggttcaccgcacgcgcgagttccgcgttcgtgatccgcgcgttctgctggagctggttcaggatgccgatgtcgatgcggtcgagccgccgcgggtttgaactcatggtcgaaatattccggaagagtggccacaaccggaatatttacactatcggcgcgcgaaatcccaatgaaatcagacgcatattttgcggatcgacgggtagcatgatccgaccgattgccactgatgcgcgccgctccgaaccggcgcgcaggagacctgcgatgacggacctgtcgaacggtatcgatgccacgcggcgcgcgggcgccgctcacgccgacgccgaccctgaagaaaccgccgaatggctggaggcgctcgacgccgtcgtcgcgcacgtcggcaaggagcgcgcccaatacctgctcggccggctcgccgcgcatgcgcacacccgcgggctcgcggcgccgcgcggcccggtcacgccgtacgtgaacacgatcgccgcgcacgagcagccgccctatccgggcgacgccgatctcgaggaacggctgtccgcggcactgcgctggaacgcgctcgcgatggtcgtgcgcgcgaaccgggcgtacggcgagctcggcggccacatcgcgagctacgcgtcggcatccgacctgttcgaagtcggcttcaaccacttcttccgcgcggcaccggccggcgcgggccatgaacggccccggcggcgatctcgtgtacttccagccgcattcgtcgccgggcgtctacgcacgtgcgtatctcgaaggctttctcggcgaagaccatctcacgcactatcgccgtgaaatcgccgggcccgggctgtgttcgtatccgcacccgtggctgatgcccgacttctggcagttcccgaccggctcgatgggcatcggcccgatcaacgcgatctaccaggcgcgcttcatgcgctacctgcagcatcgcgggctcgcgaacaccgccggccgcaccgtgtggggtttcttcggcgacggcgagatggacgagcccgaatcgctcggcgcgctgtcgctcgccgcccgcgaggggctcgacaacctcgtgttcgtgatcaactgcaacctgcagcggctcgacggcccggtgcgcggcaacggccgcgtgatcgacgaactcgaggcgctgttcgccggcgccggctggaacacgatcaaggtgctgtggggttccgactgggatccgctgttcgcgcgcgatcacgcgggcgcactcgcgcgcgcgttcgccgataccgtcgacggccagttccagaccttctccgcgaacgacggcgcgtataaccgtgcgcgcttcttcagccgcgacccggcgctcgaggcgctcgccgcgcagctcaccgacgccgaaatcgaccgcctgcgccgcggcggccacgatgcacgcaagctgcacgccgcatatgcgcgcgcactcgcccatcgcggccagccgaccgtgatcctcgcgaagacgatgaaaggttacgggatgggttcggccggccagggccggatgacgacccatcagcagaagaaactcgacgtcgacgacctgaaggcgttccgcgaccgcttccggttgccgctgtcggacggcgacgtcgagcagctgaagttttacaagccagcggaagacagcccggaaatgcgttacctgcatgcccgccgggctgccctgggaggctatctgcccagaaggcggatggcggcatcgaagggctgaccgtcccttcgatgccggcctggggtgcgttcgcgctggatgcggccggccgcgagatgtcgacgacgatggcactcgtgcgcatgcttgccgcgttgatcaaggatcgcgagctcggcccgcgcatcgtgccgatcgtggccgacgaagcacgcacgttcggcatggcgagcctgttccggcaggtcggcatctactcgccgctcggccagcgctacgaacccgaggatctcggctcgatgctctactaccgcgaggacacgcgcggccagattctcgaggaagggatttcggaagccggcgcggtgtcgtcgtggatcgccgcggcgacgtcgtacagcgtgcacgacctgccgatgctgccgttctacatctactactcgatgttcggtttccagcgcatcggcgacctgatctgggcggctgccgaccagcgctcgcgcggcttcctcgtcggcgcgacgtcgggccgcacgacgctcggcggcgagggcctgcagcaccaggacggcagcagccatctcgcggcgtcgacgattccgaactgccgcgcgtacgacccggcgttcgcgtacgaagtcgcgacgatcgtcgatgccggcatgcgcgagatggtcgaacagcagcgcgacgtgttctattacgtgaccgtcatgaacgagaactacgcgcagccgtcgatgcccggcgacgatccggccgcgcgtcgcgaaggcatcctgaaggggatgcaccggctgccggccgagtcgaacgcgaccgcgcgcgtgcagttgctcggcgcgggtgcgattctcggcgaagtgctcgccgcgcagcggatgctgaaggacgactggggatcgatgcggccgtctggagcgtcacgagcttcagcgaattgcagcgcgacgggatggaagccgaacggctgtcacggctcggcgacggcccggcatcgtcgtatgtcacgcggatgctcgaaggcacgcacggcccggtggtcgccgcgaccgactacgtgcgcgcggtgcccgagctgatccgcgcctacgtgccgcgccgctacgtgacgctcggcaccgacgggttcgggcgcagcgacacgcgcggtgcgctgcgcgcgttcttcgaggtcgatcgcgcgagcatcgtgctcgccgcgctgaaggcgctggccgatgacggggaactcgatgcggcggtcgtgcgagacgcacgcgagcgtctcggcaagacctcgcctccaggcgtcgcgccgtggcagcgctgaccgagtgacgcgaccgggcagcagccgacgacgattcgtcaaccaaagcaattctttggtcagccaaacaggcggggatccggcacgaacgcttctttgccgatcactttcacacttgaagcaaaatccgcatgcagcgggttcagcagcaagttgaaatcggtcgggcaaacgtgtggttgctgccatggcgactcccaaatgggttgattcaaattcccatttgatactcccaatcgggagttttcaatcgaccaaacggcatatccgtcaccaacgggaatcgacggcgctccgcgctacaccggcaacgcgtgcgtcgacagaatctccttgagcaccatgaacgagcgcacctgccgcacgccgggcaggtacagcaactgttcggcatgcaaccggttgaagctctcgttgtcgcgcgtgcggaccagcatgaagtagtcgaattcgcccgtcacgacgtggcactcgacacaccccgacactttctgtgcggccttctcgaattcggcgaacgcctccggcgtcgagcgatccagcacgaagccgatcacgaccagcatcccggcacccagcggcttcgggtcgagcaacgcgacgatgccgcgaatcaatccaatctccttcaaccgctcgacgcgccgcagacacgccggcgcgctcagcttcaccttcgcggcgaggctcacgttcgaaatcgacgcatcctgctgcaactgccgcaggatcgcccggtcgatgcgatcgagcgccggcgcggcgtcggccggggatgcgctaccgcgatctaatttcattgcgtctcccatccattttgcaaatcaaaattatctcgactatcaatatctcatcgataacgtaggtcgtcgccatttatttcgcaagctcatttcgcgccgtcctgcctatcatttttccatcgggacacggcgtgcgagcagcacccgaccgatccggtttcctgcccaccttccctcggagcttgtcgatgaacctgcaacgtttccccgttatccgctcacgttcggcccgaccccgatccagccgctcaagcgcctgagtgcgcatctcggcggcaaggtcgagctgtatgcgaagcgcgaggactgcaacagcggcctcgcattcggcggcaacaagacgcgcaagctcgaatacctcgtgcccgacgcgctcgcgcaaggtgccgacacgctcgtgtcgatcggcggcgtgcagtcgaaccagacgcgccaggtcgcggccgtcgccgcgcatctcgggatgaagtgcgtgctcgtgcaggagcactgggtcaactatgaagaccccgtgtacgaccgcgtcggcaacatccagctgtcgcggatgatgggtgccgacgtgcggctcgtcgccgacggtttcgacatcggcattcgccgcagctgggaagaagcaatggaaagcgtgcggcaggcgggcggcaagccgtatccgataccggccgggtgttccgagcatccgctcggcgggctcggcttcgtaggcttcgcggaagaagtgcgggaacaggaagcgcagctcggcttcaagttcgattacatcgtggtctgctcggtcacgggcagcacgcaggcggggatggtcgtcggcttcgcggccgacggacgcgcggatcgcgtgatcggcatcgacgcgtcggcgacgcccgagcgcacgcacgagcagatcacgcggatcgcacggcacacggccgagctggtcgggctggggcgcgatatcgaaacgaaggacgtggtgctcgacacgcgctatgccgggccggaatacggactcccgaacgatggcacgctggaggcgattcgtctgtgcgcgcggctggaaggcatgctgaccgatcccgtctatgaagggaaatcgatgcacgggatgatcgacaaggtgcggcgcggggaattcgagccggggtcgaaggtgctgtatgcgcaccttggcggggtgccggcgttgagtgcttacgcggagatcttccgcaacggctgatgggtatccgaagtcgatcccgcgcgcgatgggccaattccacgcaatgatgcagccgcctccggcatccgccggaggcgcagtcatgccggataaccggttgtcgagcgccgtgccgttctgcgcggcggcgcggcggcctgtcggaccatcgccgcgcccatcatggcgttcgcgcgtcagtccatgaatacgatcgaccggcgagcgcgtacctctcgacgatccagtgcgcacgactgcgcagcgtccgcggtcgtcggccatccacgtcgcaagcctctcccgccgtcgcgccggcaagcacggcgtcgttccgttcagtcgccgggcaatctcgacagcgcagcctccacctcctcgcgcatcgccggccattccggcttgagcgcatcgacaccgcccgcggccagcgcacgctcgcctcttgcgcacgcatcgctcgcgtctgcgtcgccggccagcgcgaagccgcctcgcatcgaatgcagctcgcccttgaggcaatcgtcgtcgccgcgcagcaatgcggcgtcgatcgtcgccagcgagcgcagcgtcgcggcacgcaattgttcgcgcatctcttccgtcatcagcggcacctgccggtcgtcgcgatcgaccacatgcaacgccgtcgcgccgcgcccccgtggcgccgcaacaccgcatcgagtgcatcgatcgacagcggcttgagcacgacctccgcgacgccaacctgcgcgcaccgccgacggtcctcttcggtcgcgtgcgcggtcatcgcgatcacgggtaccgtcgccctgctcgcgcaggaagttcgccagcgcgaagccgtcgagttcgggcatgccgagatcggtcagcacgacatcgaacgactgcgaaagtacgcacgcatcgcctcgacgccgttcgtgacgatcgtcgcatcgtagctcagcgcatcgagctgatcccgcaacagcacgcggctcgccgggtgatcttccgcgacgagcacgcgcagcggcacgccgccgtccgggcgcgtcggccacgctggcgccgcggcgggttcgtcgtcgaacgcaacgcgccatccggacggcgccctcgccaacggcagcgatgcggtgaaggtcgtccccgcacccggttggctgtcgaccgtcagcgcaccgctcatcaggcgcgcgagacgtccgcaaagcggcagccccagccccgtgccgccgaagcgccggtaaatcgacggatcggtctgcacgtacacatcgaacagcgccggtagcgcttccgcaggaatgccgatgcccgtgtcgcgcaccgagatttcgacgccgtgctgcctgccggaagcgacggccggcagcgcgtcgatcgtcacgctgccatgctcggtgaacttgatcgcattactgacaaggttcgacacgatctggcgcaggcgggtcggatcgccgacgtaaccgtcggccagccccggcgcaacacggcattcgagtacgagccgtttcgcttcggcgagcggacgaaagatcgccgcgacgtcgagcagcacggctcgcaggtcgaacggcacggcttccagcaccatctggttggattcggccttcgacaggtcgagcacgtcgttgatcacgcgcagcagtgcgtcggacgacgacatgaccgtctgcagccgacgctgttcggtcgatggcaatgccgcacgcgccatcaattcgagattgccgacgatcgcgttcagcggcgtgcgaatctcgtggctcatcgtcgccaggaaggtcgacttcgccttgttcgcgtcgtccgcggcttcgcgtgcctcgcgcagcttgtcctcggcctgcttgcgcgcggtgatgtcggtcagcgtacagagcagtacatcgacgccgcgatagcgggtacggacgatgtgcgcggcaaggtaggccgccccgccatcggcgcggtcgaccgacaactcgtgcgtgacgacgcgcggcttccgaccgcccgcgatactgtcgcggtatgcctgccagatgcgcttgccgagcgacggcgccatgccggcgccgccataagcctgtgcggcctcgttgcgcgccatcgtgtcgccgttggccagcgccagcagcatgatgccggccggcgccgtgcgaatcagcgtgcggttcagcgcctcgctttcgatcagccggatcgcgcggcggttggcagggcgcagcgcgcgccggtcgaacatgacgatcgcgaaccacaccgttccgatcgcgagcaacgcgagaccggttgcgatacccaggcggacggccacgtcgtcgaacaggccacgccacgaatacgtcgcggtcagcacctcgcggaaccccggcatgcggtcgccgatgacgatactcgtgccgacacggtgtgcggcggcccgctcgccaccggccgcgcgcgcataatcgagcgcgcgggcggtcagcgcgggggcaacctgccggccggtcaggacattcgtgtgcgaatcgaccagtgcatagtcatggccggaggacgaggcgcgcaggatgtcgtcgatctccggccgcgcgacgacgacaaaccatgcgaccggcttgccctcgctgtcccgcaccgcctgcgcgaaccgcagcacggaccgcccgagcagcggatcctgccgccggtccagaaaaatctgccgattgccgggcgcggcagccgccgatacaaactcggccggcggctgcaactgccggatcaacgccttcacgtcgaaaccggccggcagcgcgagcgtcgccttcaccagcggatacccggccacgatgacgaagtcgccgtccggatcgatcagatatccgcccatgcccgggtcgccgggctgcctcggcggcatgacacccgtcttctcgaccggctcgagaaacgccgcgagaaacggcgcgtaggccccctggccggggcgacggatcggccgcgaacgcggccaccgccacgcgtcccgtgtgtccgagaacggccagcctgccgcgatcgtcggcaaaccgcttgagtgcatcggacggcgcggtcggcaagtgccgggccatcaactcgaggttttcgacatagcgattctggagcgccctgaccacctccatctccgcgagcaggtcggccttccgtagcaggaactcggaacggtcacgcgcaaccgactcctgcaggtcgagctgcgcgaccagtgccgcgcagaccagcacgaacaccgtgatcgccacaccgcttccgtacagcaaccattgctgctggcgtcgcacgcgccccggctcgaacggcttgcggcccgcggccgcggcatgcgcgatcagcgttttcagtttggtgggcataggtgtcgtcgaagtcgtctcggcaccggcaccgcgtcatgcgttgtccgggtcactcggtactgtccgccgggcgccgttcatgcaccggcctcgggcaagtcgggcagatggccctcgctcgcgtagcgaatcagatcggcatcgcgaacgataccgagcttcttcatcgcgctcgatttctgcgaactgatcgtctgcttgctgcgatgaagctggacggcgatctcgccgaccgtcaggccggccccgtaaagccgcacgacttcgatctcgcgggcggtcagcgtgcggacacccgccgacggctggcagtcctccagcagcttcttgacgaacggagacagataattggcaccgacgaaagccgcatgcaccgcgccgaccagatgcgaaatcgcatcggacttgctcaggatgcacccgacaccctgcttctggatcgcgagcagcacgctcgggttgtcgatcatcgtgatcgtcacgaggcgaagtgccgggtagcgacgctggaggaaggacagcagtgaaagaccgtcgccatacttgccgccgggcatgacgtagtcgacgacgagcacgtcgctttgctgctcgtcgagcatcgccacgagatcggtcgaattcgagacagtgccgagcagcttgatcgtgctgctgccagcaagcgcctgcgacattccgagtgcggacgaaggatgatcgtccgccaccatcactcgcacaaaaattcatccatttatcttcttctcccgatacacgcggcctgacgtgccatgttgtgcgacgcgccgggacttgaatcgatcccgcaacacggtcgcgtcacggcgttcggcgaacccggcggtgcgcagcgtaattttaagataatagacgggttccgcggcggctctgcgctccggcgtggcggcctgtacccgccacgatccgacgcacgtgccatcacgcacgcagacgcgcccggcgtgacgttacgggccgaaccgtcgagagtccgccgcccatgcacgtccgatcggcggcgcccccacgccgtcgatccatcccgtcccgcaaggcggccgaagccgcgccctaatgcttgaccgcggttttgtcctgctcaccagacctgtcatccgcggcgtgctgccactcggtgatggcccgccgcttctgcgacggcgacatcatcatgaattcgttcagcttcgtcaggaaatcccgtcgggatttctccggcaacgtcgcgaatccaagcagcagcccgaacacctttcccatatagcgcactgccttacccttccttcttcagtcgaattcacgcggcatcgaagcaatgcggcgtgtctgccttcctgttctgacgcaggcgatctacgtcgccgatgcgccaccatttctatcgtcccggccagtgtgccgccgcagcggccactacgcccgaagctggcggcccgtccgccgcgcccgcgggcaacacgatcccgcgccgccgcgcgatgcgtacgaggccgcggcgcaggtcggccagcgttaccggcttggtcaacacgcacgcgacgttcgatgccgcgtagcgccgggcatcgtcgggcaccagatgcgatgccacgacgatcatgtcgcacggcaaggcgcgcgcatgtacggcttccgccagttcccgggccgacatgtcgggcaggtcggcaccgagcagcagcacgtcccacgtgccgttcgcgagcgtgtcgagcgccgcgccgccggacgacacgcaccggaccgtgcaaccgagcacatccagctgctcgcggaaaatcgacccgttgaccgccgcatcgtcggccaccagcacacgcggcacacgcgcactggaggccggcaacaacggctgccagaaatcggtcgcgcgccccggcccgcgcagcgactcggcggtagcgactcgcgcctgcgcgatcgccatgcacagcccgttcagcgaataactcgacacgcggatcgtccggcccgcgacatccggctgcagcgggccgtccggcgtagccagcacgaccggggtctccccgccgagactgtcgagctcctcgcgccgccattggtcggagtcgccgaagagcacgatcgcgtgtgcacgcgcgaggcacccggcggcaatcccgatcggactcggatgcatcgcgacgtcgaaaccccatgcccgcagatggggaaatgcaaacgcacgccacgcgtcctccggcgacacgacgatcagcgtctggccggcgcccgcgccggccggggatttcggcgcaatgcccgcgcgcagcggcaagcgcacggtaaacaggctgccgacacgcggcgcgctgtcgaccgaaatcgtgccgcccatcgccgcgaccagccgatcgcacagcgcgagcccgagccccgtgccgccgtagcgccgcgtgatcgatgcgtcgacctgcgagaacggcttgaacagccggttctgctgcgcgaagtcgatcccgatgccggtatcctcgatgccgatcgcgatctcgggcgcaccacgcgcactccgcccgaccgccacgcgcgcgacgatacgcccgtcgctcgtgaacttgatcgcgttgctcaacaggttgccgaccacctgtgcgagccgcgtcggatcaccgcgcatccgctgcgcgccgctcgcatcgatatcggcgaacagcggcaaccctttgcctttgcgaccggtgcgaaggccgcgagctcgcgttcgatcaccgcgatcacgtcgaactcgatcgactcgaccgacatcgcgccagcttcgatcttcgagaaatcgagcacgtcgctgacgatcgcgagcagcccttcggccgacgcgcgcaacgtccgcacgcggctctgctgcgatgcgtcgagcgccgtgcgctcgagcagctcgaggttgccgaggatcacgttgagcggcgtgcggatctcatggctcgtcgcggcgagaaacgacgacttggccgcattcgccgaatcggccgcgcgcacggcttcctcgagctgacgaacgaggcggcgctgcgcgctcgtgtcggcgaacgtcgcaatcagcacgtcctcgccctgataacgtgcgctgtgcgcgatgacctccaggtgcagcggcacatcgccgcgtgcgtcgagcatgagttcggtcgtcatcgtccggcctgccccgccgttcgcgacgaacgcgtcgtacttctcgagtacctgcgcggacagcgcatggtgatcgccttcatgcggcagcagcatctgcgtgagcgcgtcgctcgcgagcatcacgcgccggtcggacagcgacacgaggccgatgccgaccggcgccatcgcgatcacgctgcggcacagcgcctcgctgtcgaacacgcgggccgagcgtgcatacacaggcacaagcacgcgccggtgaaagcgcacgagcagcaaccacatcacgacgatcgcaacgagggtcgacgccgcgagcgcgccggcctgcacgccgatgccggccaccacgtcgccccacgacagcgcataggcgatcgtccagccggttgccgcgagcttgctgctgaacacgatcgcgccgtcgcgaaagagcggctcggcggacacggcgccacgatgcgcgacatcgaggttcaacaagcgctcggtgagtgcgttcgtgcgttcgacgtcgggatcgatcgcgatcagccggttgtccgccgacgtgacgaagaacgtgccggccagggcccgcccgggcagccatgacagcaggtattcgggtgcgtattcggtgaccagcaccgcgaacggctggccggcggcgcgcgcctcggcggcaacgcggatgcgcacctgcccggtgacggggttgacgtagggcggcagccaacggacattcggccgaccgtcgttcggggccggcggcgagccgtcgaaatcgacgcgcaacgcatcgagcacgtgtgcacgtgcgccggccgatgccagcgcgggattgtcgcgcgtcaggtgcggcacgaggccgaagacgcccgtgcgcgtgctgtagtggtaaccctcgagcgtgcgcccgcgattgagcgaactcgccgcgcagatgcgcgacagcaggaacgacaacgcgagatagcgcgcgacctcgtcgcgctgcgccgtttgccccggcacgccgaccacgagcgacggatacggcttgatcgcgagctgctggccgtcggcgaagaacgtgtgcacgacgtcggccggcgccgcgccgatctctcgccagatgagttgcgtattcgtgacgccgttgcggaacgacgtctcggccacctgtatctcgtccgaggcttcctcgacaccgttcaggaaattgcgccgctcgccgtccagatagccgtagacgatcgacgtgatcccgagcccgcaggcgatcaggatcaggatcgtgacgacgatgccgccccgaacatcgaaatgctctggtagcggcgaatggactgaagcgtgctgtatgacatgactcggcgtgacggagccctgggcgcggacctgcagcagatcccctgcggatggacgtcacgatggaaacaatcgggatagcgatgtcccgatcatgccaaacgacactgcgaaaatcaggcgtgcattatccttttagtacacgtcctatttgtttgaatgattgttttgaacttgaacgaaactcgacggcggaatcgtgtgtcgcgcacctgtccgtccggataggttgcttcatcgaatcgcggcaggcacgcccgaaatgaaataccgccggcaagccggcggcaaagatgcgtcaacgaatctcgcgacgcaccgaggcacccgattcgacccgcgcggaacgacccggcaggatcgcccgcgcaccgccgttgtgccggcagcgcccgctcagttctgcgtgagcggattgagcgtcgtgcacaggaagcccgtgcagttcgtcggcttgaaatagaacgatgccgtcacgatcggcggcgtggtgccgagcgcgatatcgctcaggtaagcggagccttgcgcaccgaaaccgttcgcctgctgcacgaagctcgcgccggtcgactggatcgcggccgactggtaggtgaaggtcggcgattgcgtctggtccttcacgtagacccacgagatcgtgctgccgaacagcatcccgcccttcgcgcgataacccttcgcgccttcgctgttggcctgcgcgatgaagtcgctgacgttcgtcgtcggcgcgagggcgtcgtacgtgtaggtcgcgcccgacgcattgttcttcatgtacacgttcgcctgtaccgagccgatcaccatcgggcccaggaaccagtagcccgactggccctggccgttcgcctgcgtgaggaacgcgttcgggtcggcaggcaggccggtcgtcgtgtacgtgtaggtggccgacgaaccgccatccttgcgatacaggttgccgtacgtgagcggcccttcgtagcgatagccgttcgtgccctgcgtgttggcctggttgaggaaggtcgtccagtcgcccggcgtggattgcaactggtacgtgtaggtctgcgcggtgccgtcgttcacgaagatcgagcgcgaaccgccgctggatgcgttgtagtaatagtcgcccaggtagcggtagccctttgcgccttcactgttgaggagcgtcaggaaacttgcctgatccgccgcggtcggctgtgcgtcgtagcgccacgtcatcgtgctgccgcctgaaccgcctgaaccgcccgaaccgcccgagccaccgctgccgccgttgccgccgcttccactaccgcctgtgccaccagtgccgccggtgccgccgttgttgctcgtccccgatccgccggacgcggcgggcgaggaattgtcgtcgccgccgcaagcggtcagcgccagacaggtcaatgcgatcaatgcagcggctttcatcggggtcacctcgaagcaaaaagatgagcgaagccggtacgcgcggaatcacaccacgcgtacggacaatctcgaatcggaaatcggcccgcggcgccgcgggcccgtcaacgtcagttgacctgcagctggccgccgcggccgaggccgcccttgacgtcctgcgccttgtagctgcgcagtgcaacgaccatcttgttgtacgcgtcgatgaacgcaacgaccgtcgccttgccttccggcgtcgacgagaagcccgcgagcgcaccgcccacgccgccgccgaagccgcccagcgcggcgccgtagttggtcgccgtcgagctgccttccgatgccgcgatctgcacggccgagcgcacgtcgaacagcgtcagcgtgacgaccgatgccttcgtctgcaggtggccggccacagccgccaccgcgctgttgccgatcagcccgccgatcatgctgccgatgccgccgatcggcgaatcgttgatgacgatctgcggttccatgtagtagtcggccgcgacacgctggcccttctgctgcttcgagcccgcgcggtattcgcccgagttgcgctgcagctgcgtgatgcgcgacaggcgcgcgtcgctcttctggttgccgatcgacgtgatcacgaagcagttcgactgctggacggccaggcgcagcagcgggtcgatcgtcgtcatcttggtcgcgctgccgaacgggccccaccagtcggcattgcggccgtcgtcgaccgcgatcgtgccgagcggcgacgcgcagcgctgcagccccgtgtcggcgccggcgctcgtgccgcccgcggcggcaccggtcacgcccgcgttctgaccgccgggcgtcaccatgccgccgcagcccgccacggacgcgcaaagcgctgcgaccagcgcaccttgagtgagacgttgggaaaggttggtcttcatgtcgttgtcgatcgattagagtcgttgttcggcttatgtgttcgtgcgaacttcgataagccccggctggcgcgcgatggtggtctcccgctgctgcccccgttgcttcaggcccggtcagtagtaccagtacgtctgctgccagacgccgtagtacggatagcccgagtaccagtagccgtaatagacgtcacgccactgcgtgcgccatttccagtcttcttcgtcttccttcttggccttgcgtgcaaggtcgagcagtttcttcgactccttgtcgccgcggccggccgcgatcgacagccacttctccgcttcgcgcgcgtcggagcccatttcctcgaggccgaacaggtagaaactgccgagcgccttctgcgcctgcaggtcgccgcgctcggcggcctcgcgcatccacttgagggcctggtagctgtcctggcgcacgccgtcgccgcggaagtagcgcaggccgaggtcgtacgcggccttcggctgggtcttcgcggtttgcttcagcgcggcgatgcgcggatcttcccggtcttccgaatcgtcctttttctgataggagacctgatctttcgggcggtaagaacaacccgtgtcgtcgcagatccgcaccgtgttgccggtgacggacggatcctgcgcgcacgcggccaacagcaacagcagccccggtgcgagtagacggcggaacattggtactttcctcaagttttattggcgccgcaattcttcgagcctttcacccccgtgagctcgcacccggcggcgcgcggcgcaacggatacaatccgtcgacgccgacacgcaccccaaggctctctcaggttctctcttcgaatcgttcagtcaccgcttcattgttgtcgcttttcgttgtaccggctcccgccggctgcgatctcaaacatgacgcgacaaacaaaggtgacgtggtgagcaataataatggagaaaaacagcatgtcaaggtgattcgcttcttcaaagtttgcgtgtcacgtcagttttgatatgctctcctcgccaaaacccctggagaccccatcgagatgtccaacagcgagcaggccaacgtcgatctgatcaccgccaacaaggtgcgcgacctactgaaccggaacggcattccgccgcgaagtcacaacacgacgatcgcgaacgtgctcggcctcagcttctctgtcgtcacccgcaagatgaagggcctgatcccgtggaacctgtcgcagttgcaggacatcgcgacgcatttcggcgtgccgcccgcgatcctgctcgacgacaagggcacgcagccggccgccgccgagatgatcgacgcgacgctcgtgatcgagtcgcggcgctttcgctgccgcgccgcgatctcgaccaaggccagcagccagatcgagacggacttcgtcgcgctgcaatggcagggcgagtggctcatcaccgagcgtcagcacgcgcgcgagggccgcacgtatccggtcgacgtgatcgagctgcgctcgtcccagccgaacgtgtatgcggcgcggatcgccgtggtcgacgattcgcaggacgtcgccgaaaccgtatgtgaatatttcatcgaaaaaggcgtgaacgcgatcccgtacttcgacggcgcatcgttccgcaaggcactcgaggtagaggatttcgacggttacatcctcgactggatgctcggcgaccagaccgccgccgaactcgtgcgcggcatccgctcgagcgagaacagcggcgcgccgatcttcctgctgaccggcaagatctcgaccggtgaagccagcgaagacgaaatcgcgcacatcgtgtcgcactacaacgcgcgctgcgaggaaaagccggtgcgcctgccgatcctgttcgccgaagtggcgcgcgaactgaagatcacgctgccggccgcggccgccgcgaactgagaccggaaacacaagccaccacaccacgcgacaagaccgagggaatgacatgcgaattccgaccatctggaccaagagcctgctgacggcctgcctgctcggcatggccgccgcggcgtgggccgcctcgtcgttcacgttcaccgtcgacggcaagatcgacaggcacaaccagccgggcaagacggcctacgtcttctccgaacaggcactgatggcgcttccccagcacacgatcgtcacgtcgacgagttggacgccgaaggcgaccttcaccggcccgcgcctgtccgacatcctgaagaccgtcggcgcgcacggcacgcagatcgagttccgctgcatcgacgagtacacgttcacgattcccgtgtccgacgccgaccgctacggggtgatcctcgcgcggacgatgaacggcaaggtgctcgacaacgacaactatggcccgctgtggatcatgtatccgcgcgaccagtatcccgacgaactgaagacgccgctcggcgaagccaagttcgcgtggcagatcatcggcctgacggtgaaatgaaacgcgggcgatggaaaaatagaaaaatcatcctggtcctcggctcgctgtggatcatggggttcgccgcgtgggcgttcctgctgtgggacctcctcgccacctcggtcaacgagggcgtactcgaagggccccgcgaaggcgtgttctggaccgccgcgcaataccggaacgtctatacgcggttcgaccggcaactgatcctctacgcgacgcacgaggacgacgacttcaatcacgtccagatgcagctcgacagcctgtcggtgtcgttcggctttctgcagcggccgtcggaagtgtcccaatactggctgcgcatcccgcgcgcgcgcaacgagatcgacgcgctcggcgaattcatgacgcgcctgaagcgcgacgtaccgccgttgcgcgattcgccgaagcgcgcacggcaggtgatcgacgacgtgaacgcgtactggccgaaggtcaacggcctcgcgaactatttccgcgcgatcgagatggcgcagcgcgacttcacgttccatcagctgaaggaaaagcagcgcgcgatcctgatcctcggcatcgtgctcggcgtgatcctctgcgcgctgttcctgctgctgttctatacgatgcgcacgcgtgacgacctgctcgaacggcaggacgcggcgctcgacgcggaacgcaaggcgtccgatcgcgcgttcgaaatgatcgaggcgaagaacgcattcctcgggatggtcagccacgagttgcgcacgccgctgcaggcgatctgcggatcggtcgagatcctgctcgcgcgcccgcagtcggacgcgaacctgaagacgatccggcggctgcagaattccgcgctgtccctcgaggcgctcgtcaaggacctgaccgactacatcaagctgcgctcgacgaagcgcctcaccgagcgggaaaccgtcggcatcgcgtcgctgctcgccgaggtgctcgacccgctgcgcgagaagatcgcggccaggcggatcacggtcacgcagcgagtcgagccgcagcagcttgcgatccgttccgatcgcaagctgctgcgtcaggtgctgtcgaacctgatcgagaactcggtcaagtacacgctcggcggatcgatcgacgtgtcgatcacgctcgccgacgcgccggccggccagcaattgaagatcgccgtgcgcgacacgggcgccggcatcgcgaaacagcacctgtcgaagatcttcgagccgttctatcgcgcgaacgacgcggtcgggctgcatgtggacggaatcggcatggggctcgccgtcgtgcgcgaaatcgtgacgacgctgcgtgggcatgtggacgtgcgcagcacggtgggcgaaggcagcgagttcgtcgtgacgctgccggccgaagtgcccggcatcgacaccgccggcaatgcggccggcgacgcgcccgcgctgccgcacgcggccgcgtaccgcgaccggcgcgcgctggtggtcgacgacgacgacaacgcacgcgaaacgcttggcgcgatgctgtcggcgctcggcatcgacgtcgatctgtgcagcaccgggcaggaaggcgtcgcgcgcttcggtgcgagccgctacgacatcgtcgtgctcgatctcgagcttccggacctgagcggtttcgacgtcgcacggcgcattcgcgcggtggcacaacccgacgacgacggccgacatccggcgatcctcggcgtcagcgcgtatgaatcggctgcgctgggcgaaaacaagcgggtattcgacgcattcctgccgaagcccgtccacctgcgagaactcggtgcgctcgtcgacaaactgctcgcgtaagcccgcgatgccgtgtgcgcataggcaccgcattgcgagccgcgcgtgacgtcacccgtcgagactcattcgccgatcagatgcagcacgatgtcgcgccggtgcgcggcgcggcgatgctcgaacaggtagatgccctgccacgtgccgagcaccatgcgcccgtgctcgaccgggatcgacagctgtacctgcgtgagcgccgtgcgcagatgcgcgggcatgtcgtcgggcccttcggtgtcgtgctcgtagcgcgtggcgtcctccggtgcgagcgtcgcgaagtagcgttcgagatcgcgctgcaccgacggatccgcattctcctggatcagcagcgacgccgacgtatggcggcagaacaccgtgagcaggccggtgcggatcgcctgctggtcgacgaatgcgcgcacctgcggcgtgaattcgacgaggccgctgccgcgcgtgtcgacgccgatgtgcgtgatggcctgttgcatctcggtgacctcaggcgagcgcggcgaagccgtcggcttcgatctgcttcgcgtcggccggacgcacgacgcgcgcgacctcgacaccgtcgcgcaggaagacgagtgtcggccacagcttcacgccgaacgagcggccgagcgggcggcccgggccatcctcgatcttcaggtgccgcaccgcaggatgcgcggagaacgacgcagtgatcgcgggctgcgcgcctgcgcagatcccgcaccagttcgcgccgaattcgatgacggtggcgccgcccagtgcgtcgacttccgcgcgcgtcggtgcattggcggtgtagcgttgctcggtatccatcaggccctcgtgtgcgttggcggaacgtggccgcgcccgcgtgcgtggtgcggcggtcgcggcctgcgatttcctactctagcggaaaagcgcgcgtgatgccggcctgcccattgcggcgcccacgccgcctgcgccctccggaatgacacgacaagattcggagcgccgtgccgccgcgacaggatcagcatgcggactgattcgtcaccgagggcacccgccatgaatgcgccgcattgcgtcaccgaaccgaacatcctctatttcggcacgcccgtcgtgctggtcagcacgctgaacgaaaacggcacgcccaatctcgcgccgatctcgtccgcgttctggctcggctggcgcggcgtgatcggcatcgccgccagctcgcagaccacccgcaacctgctgcgcaccggcgaatgcgtgctgaatctgccgtcgtcggcgcaggcggacgcggtcgaccggatcgcgcgcacgacgggcacgcatccggtgcccgacgggaagcgcgcgagaggctacgtattcgagcccgacaagttcggcacggccgggctcaccgcaaccgcgtcgcaaaccgtcgcgccgccgcgcgcgctcgaatgcccggtgcacatggaagcggtcgtcgcggccacgcacgggatcggcgacgaggcgccggacctgcgcggccacatccgcgtgttcgagttgcgcatccagcgtgtgcacgtgcatcccgacctgctgatggaaggccacgcagaccgcatcgatccggacaaatggtcgccgctgatcatgagcttccagaagttctacgggctggcgccgcggcaggtgcatgcgtcgcggctcgcggagattcccgagcgcgcgtatcgcagccccgatatcgagcgttcgcgtgaagcgggcatgttgaccagcgctggacggtaacgaagcgcccggcgcaatggccgtgaaccccgtgcttcgtcgtgcctccaccggcggtatcgatgcggctgcgccgaccccgcaccgcctcgtactgccggccctgtgcatcgccgtgccgatcgcgcggatcgacaccgcgaacctatcccgcctcgcggcccgccatgcgttccatccattgctcgaacgcggacaccgcggcatcgtcggcacgatcggcgttcgtcaccagcatgtagtcgtcagcacgccatacgggcgacgcgatcggacacacgaggcgccctcggcgagatcgcgcccgatcagcggcagtgaggccagggccacgccgagcccctcgatcgccgcgccgagctgaagattcacgtgatcgaattcgacatgacgcgcggcgcgcagatcggaagccccgcttcctgcaaccagtgcgaccaggcggagcgcgtcgtggccgaatgcagcagggtgtgatggcgcaggtcggccacgctctgtatcggttgccggcgcagcaatgcgggattgcaggccggcacgcgcaggtcgggcatcaacgggcgcgatacgacgcccgcgccctgctcgggaccggaacgaacaccgatatcgaaagcgtcggcgacatagcgcaacttgcgcgatgtcgtcgacaccctcacgtcgatgtcggggtagcgcgaatggaaatcggcgagccgcggcagcagccagcacagcgcaaagctcatcggcacattcacccgcacgacgcccgatatccggtgcttgaacgtgtcgtggcgcagccgccccaccgcggtaccgaggcgctcgaacacgtggctgacgtcatgcagcagcgcggcccttcgtcggtcagcacgacaccgcgcggacgacggtcgaacaacggcaggccgaaccagtcctccagcagccggatctgcttgcctacggcccagtgggtgacatgcagttccaccgccgcccccgcgaagctgccgtgccgcgcgaccgcatcgaaagcgcgcagcgcattgagcggaggcaactcgccccgatgcttcgccgtgtcctggttgtcgttcatgacgtgactttttctctccgttgacgcgattttagttcaattgaaatggccgctgcgtcacccataaaattgacacatcgagcgtgaaaacgatgccacgagcggcttccaccgaccgctcgcacggagcaaatgacgatgcgcctgccggtttttccctcccgcgacgcgggagactgcgccaccccgacggcgcgtgctgtggctgtcctgcattgcgcacgcaatgcacgatggctatacggacatgatctacgcgctgctacccgtgtggcagtcggaattcgggctcgactttgcggccctggccatcctgcgcggcatctatgccggcacgatggcgacgctccagttgtccgcggggcgcctcgcgcaacacctgggcagcggcacgaccctcgcattcggcacactgctcgccgcgctcggttatgcgctcgcgggcctgtcgggtggcctgctcggtctgggcgtggcgctggcgatttcgggcggcggatccagcacgcagcatccgatcgcatcgggcgccgtctctcgcctctacggacgcgacgcgagaggcccgctgagcatctacaactttgccggcgatctgggaaatccgcactgccggccgccatttcgctgctcgtgaccatgatgccgtggcgtcacgcgctatggatcgtcgccggattgggctgcgtcgtggccgccgtcatcgcgctctggtttcccgccgtgccgcgtggcgccggcaagacggcggccaaagaacaagcgtccgctcaacgcagcagcactggggaagcggattccccaccctgttttccatcggcgtgctcgatacggcggtacgcatgggactgctgacatttctgcctttcctgctcaaggcaaaggtgtctcgccgcaactgctgggaacggcgcttgcactcgttttcacaggcggtgcggccggcaaattcatgtgtggctggctgggcgcgcgtctgggtatggtcaggacggtgctgctcacggagggtggtacagccgtgtgcatcgtcgcggtgatgtatctccctttggcacttgccatggtgctgctgccgattctgggtatgatgctcaacggcacttcgtcggtgctgtacggaaccgttccggagatgtccgcacccgagcgcaccgagcgcgcattcgcgattttctacacagggacgatcgcatccggcgcgatatcgcctgttctctacggtttcctgggcgacaggatcggtgtgcatggcgccacgtatgcgaccgcgctgaccgccctcgcgatttttccgctcgccctcgcactgcgcccgcatctggcggatgactgaacaggatgaacaccatgacgaacgctgactacccgaccgtcgccctcgtcggtccgggcgcaatcggaacgaccgtcgccgcggcccttcatgaagccggccgcacgccggtgatttgcggccgctcggcgcacgaacagttgaagctgcgcttcgacggcggcgagatcgtcgtgcccgggcccgtactgaccgatccgcacgcggtcgaggaaaagttcgatctcgtgttcgttgcggtcaagtcgacgcagatagcgagtgcagcaccctgggtctccgcgctatgcgatgcgaataccgtcgtctgcgtgctgcaaaacggcgtcgagcaaaaagccgcgttcgcaccgtatgcgtccggcgccacggtcgtgccttcggtcgtctggtttccggcgcagcgcgaatcgggcgcatcggtgtggctgcggggcaagcctcggctcaccctgcccgatacgccggcgagcaacgtggtggtctccgctttgcacggcacgcgctgcgcgccggaggtggcggaggatttcatctcgctcgcctggcgcaagctcttgcagaacgcagtggcgggactcatggtgctgaccggtcgccgcgccggcatgtacgcgcgaagcgacatcaccgaactgtcgctcgcctacttgcgggaatgtctcgaggtcgcgcgggcggagggcgcgaagctgggcgatgaagtgccgcaggaaatcgtcgatggattgcatggctttccgcccgatttaggtacgtccatccttgccgaccgacaaagcaaccatccgctcgaatgggactgccggaacggcgtcgtgcagcgctacggacgaacgcacggcattccgacgccgatcagcgatctggtcgttccgcttctcgctgccgccagcgatggtccgggctagtcgcaagcaaaccccaggggatacgatcgacgcgagactcaccgccttaccggtcatagaattcggccgcaggtcaccggctcgcgccgcactgtttctcgtcagcagcgacgggcgtttcgtcaacggcgtgaacctgagtgtcgacgacgggaggtcgccgcgatgacctcccgccaggacgctcactctgccgcccggtgatacatcgcaacgtagcgagcccgggcaatcacttttccgtgcatctgatatgccacgagggccgggctcgacgtggcgttcacgtcgatactcggaacagagagcgccgatgccgtaacgatgtatcggtgcgactcccctgaggcgggcaaggcccgccgtatttcgccgcgccgaagtcggtcagcgtttcgatggcccccgcaggcatccgcttcggatcgccggaggcgccctttcgatcgacgtgtcggatgccggaatattgccgacgccccaatgcatccagcccagtccgcccgtcggggcatcggggtcgtgaatggtcacgacgacgctcttcgttccgtgaggaagatgggaccacgaaatgcgtggcgagacgtttccgccgtggcagccaaatccgccgtagacctgttcgttctcgaaccggccatggttcaggtcatcgactttgacggagaacgttcccgcgacagcgatggtcggcacgatcgacaagagcatcgcggagcagagggtcgatcgcggcaagaaattgaatgtcatggttgctccgttgaaaagaacggcgtttccgcagcaggcaagaacgatccagctggacgaagcggacgggttgccggtttcgttgcggcagatacgtcgggttggaacatgcaacaagcgttgtacaacccgcgctcaaacaaattgtagatttggattcccgacgtcagtagcgtcgccaacgcgttcaccgtgttgtcttgatggcaacaattgacgaccggcatgtcttgaaattgcgatcgcgactgtcacgctgaagcggcggcggcacgagaagcaggcatggcaaaccggccgactgcacgtcgcggagcattcccgcgtgcccgcaatcggccgccgcgcgcgcctacgatcggacaatcagactccgtgcagatcgcccggttgcgtcgaaaagtgcatcgcggcgaatcagataacatacaggccgccacctttccacgatcaaaccgacggagtgttttcagtgattcaaccgacccctgtattcaaggacaacctcgcgcaattgccggccatcgacggcatcgcgcgcatcgatctcgtcgacgcgaacggcgacgtggtcgcgaccatcgagaaccagccgggcaagcagggctcgctcgccgtgtacaactatctgcagcaggcattcggcacgctcgacgcgaaagcggccgagcacggcctcgccgtgttcgccgaacatacggccgacgcacgcaaccgcccgggcgcgcacccgaacgtcgatcgtctgctggcgatcgtcgacggcggcgaagcgctgcgcatcgacgtcatcgcgaagggctgagcaagcggcggagcgacgataccgggcatcaaggcgcggtacgttcctgcatctcgtcgaccgacggaggtgcgtgcggcatcgtcgttccggctgtagcgccgccgcgccccgtcttgccggcttgccgcgctgatgtcgccaaggacacatctctttcgtcgagcacatgccacggcctgctgcttgtcggcatgctcgatgaaaggcgcaaccccacccatgtctcgacgcacgcacgcgctcgcatttgcacatgcaataacggcgctgcgcacgggtcatcgtcatcgcgaatcgctactccgattcagtctgccgggaagatcgctcgcgataccggcgccgaatcgccccgccatccctcctgggcggcaaattccttgcaacacatcacacagcgcctgccgctgaagccgcatgccgtcccggcatcgcgagatgctgccgccgagcctctaccaggcaaggtacagatgggtgatggccagtcttcctgctcatcgcagaaatagcgtggtcgcccaagcgaaatatccgtggccccggatcgcaggtcgtcaacaccattgcttccgaaacgacgagcgcgtagccgtcgatttgatccatacggttccggactggcggcacgagcaacgagatcacggccacgaggaagctcacggggctagccgggcagtgctcccgggttgtgcatgaccggaggtggcgccccgtgctgaggtcgcgccaacgtcaccatcaagaaattcttgatcccgtgtcgcctctgcccgaggcagctcaacgccgcggattgcagatgccacacgcacgcgtcgacgcgtccgccggcgaggatgcgttgtacgcgtcaaatcgatcgaggcgggattcgcgagtatctcattcaaccggatacgcaaccagatcgcgtccatctcgaattcacggacaaaaacaccgcccacttgaatagggctttataaaaacaagtaaaaagtctgcgaaagatgatttttcctcttcgcccgacataaatttcgaaaaactccatcgacgaattcaagccagtcatatattccggaatacgtcgccaccgatcgcccgcccgtcctgcccgtcctgcctgccatctccggcattcgaccgtctcaatgtcaaatccctctgacaattaaagaaatcccccaaaccacccccaaaaatctttttcgtacttgtactacgaaatagcaatacaacttcggacacatccaattcaaataaacacccccaacagtaccattgcaccaactcttccaaagagttaacacccttcctttaaatcacgttgaaacggaaacatcatggctctcaacaaaaatattctcgctatcgccgcggcagcggccacgttcgcggcagcgggttcggctatggccgccgacggcaccatcaacttcaccggcgcgatcacgacggcatcgtgctcgctgacgggcggcgcaggcgccaacgtgtcgcccggcgccggcggtcagagcatcgcagtcaacctcggcacggtgagcgcggattcgatcggcaacaccgttggcggcggcgtcgccgcaggcacgcagatcaacctgaacctcgactgcggcaacaccggcaccggcctgaccacggtcaagatgaagttcgatccggccacgggtacgggcctcgacggcaagaacaacaagctgctgaaggtctcgggtgacgcggaaggcgtcggcatcggtctgtacgacagcaacaacaagttgctgaacctggctgccaacgaaacgttcgacgccccgctcgtgaagggcggcccggacgacgcgccgacctacaccgccgcgctgaatctgcgtgccggctatgtcgcgaacggcgcagcaatcaaggccggtgtggcaaacggcacgctgccgttcacgctgacctacgagtaagcacctcttcgggcgacgcgacgggtcacggtcccgtcgcccttctcacttttcaattccatcatgaaacgatcactcattgccgggctggtcgcggccagctcgctattaccctattccggcgcatcgttcgccggcatctcgttgaatggcacgcgcgtcgtttacacggcgcagagcaaggaagcgtccgttctcgtcaggaacccgtcgaagcaagacgtgatgattcagtcatggctggaatcggacgaccagaaaagcgatctgccgttcgcgattacgccttcgctgagtcgccttggcgccgaaaagcagcaaacgcttcggatcttctacgccggccagggtttgccgactgaccgcgaatccgtgttctggctcagcgtgcaggaaattccgcagaaatcggatggcgataacacgctgcaagtcgcggtgcgccagcgcatcaagctgttctatcggccggccaacctcgccagcaagcccgaggatgccgccaagcaactgcaatggcgctggcgcgcggcgggtggcaagtacggcatggaggtcgtcaacgcctccccatattacgtatcgctggtcagggcaacgctcaatagcggcgcgcaaacgcattcgatcaatacggaaatgattccgccgcagtcgacccgtcaactcagcgtcaagaactacaacggccaatcgcttgcaccaggcgccaaggtcaacttcgagtcgatcaacgacttcggcgcgaccgaagagaacaacgcaacagtctccaactgacaacgcattccgtcagcttcagcttcgagtcgctcgatagaaattcgcattactaatttactggaggcgcgcattcctgaaatcagggcaggtaggaacggcacgcgatcaaggtcaaggcatggataccactgaaaagaaaatcgatttgcgggtagcggcatgccagggagctacctgtctggtggcgctgggaagtctcgttgcggcaacgaccgttcaggcggcagagttcaacgaactcttcctcaagaaaggggacgcacctgtcgagctcaaatacctcgaacagggtagttccgtaccgcccggcacgtacgacgtcgacgtgtcgctgaaccagcagcccggcaagcgcgaatcgatcgtctttcaggcgaacggcggcgaggtcaagcccgtcatcacactcggcctgctcaaggcgctcggcgtggactcgcagcggctcgagcgggaaaacaggattccggccggcctgcaagacgacgcggtgctgaatctcgcggagatcgtcgacggcgcgtcggcggatttcgacgtcggcacgttgtcgctgaacatcagcatgccgcaggcctacgtgccgggacggtcgcgcggctacgtggatccgtcgaagtgggacgacggcgtagtagcggcctacagcaactatcaggccaatttcagccatgactccgactccggttacaacagctcctactattacctcggcctgcgcaacggcttcaacgttggcggctggcggctcaggaacgaatcggcgctaaccgggcgccgcggcgcgaagtcgcagttcacgtcgaaccgtacctacgtgcagcgcgacctgcgcggtatcagaggcacgctgtcggcaggcgaactgtattcggccagcgaaatcttcgacagtttccgcttcgtcggcgtgcaggtcggctcggacaccggcatgctgccggacgacgaggtcggtttcgcgccggtcgtgcgcggcatcgcgcaaaccaacgcggtcgtcgaggtgcgtcagaacggctacgtgatctactcgaccacggtcacgcccggcgcattcgagctgaaggacatctatccgagcggctccaacggcgatctcgaaatctctatcaccgaatccgacggcagcgtccggcgttatacgcagccctattcgttcctgcccgtgatgatccggcgcggctcggttcgctattcgttttccgcagggcagtatcgcggggtcggcgaagtccgcccgaagttcgcgcagggcacggtggtgtatggcctgtccgacaacttcaccggctacggcggcctgatcggcgcacagaactatgccgcgatcgcgctcggcgtcggcttcaactcgcggctcggcggcatttcgttcgacatcacgcatagccagtcgaacgcgccgggccgaaaagcgaacgggcagagcttccggttcctgtactcgaagacgctggcggccaccgacaccacgttcacgatggtcggctatcggtattcgaccgacggcttccgtacgctgagccagcacgtcgacgacatgagcaaccggcaaggcgacggcgtgcgacgccagaagagccgtgtcgacctgaacatcaaccagtcgctcggtcgcaacgggtcggtctacgcgagcgtcggcgaaacgagctactggaaccgcggcggcacgagccgcaacatccagctcggctacagcggctcgctgaagaacctcagctacagcgtcgcgctcgcgcgcacgcaggacacggggccgttcgggcgcaccgacaaccagatttcggcgacggtcagcattccgttcggcagcagcgcacgcgcgcatcgcgcgtactcgaacgtcacggcgtcgacgcgcggcgacgtgagcgtccaggcaggcgtatcgggcttcctgaacgacaggaacacggtcaactattcggtacagggcgactaccagaagggcaacggcggctccggcggcgtgggtctcggctgggatacgccgatggcgaaactgacgtcgaactacacccagtccggccacggcaagcacgtcgacgtcggcgcaaccgggtcgatcgtcgcgcatcgcggcggcgtcacgctcggccagccggtcggcgagacgttcgcgatcgtcgaggtgcccggcgtgaagggcgcacgcttcgcttcgtcgtcgacggtcagcaccgatcgtcgcggttatgcggtgctgccttacgcgcagccgtaccggtacaactggctcaacatcgacacggaaagcctcggcaacgacaccgagatcaccgagaacgcaaaaacgatcgtaccgacgcgcggcgcaatcgtgaaagcacgcttcgccgcggaaacgggccgccgcatccagttcgacgtgacgacgaccgacggcaagaaggtgccgctcggcgcaaccgcttacgaccagaacgacaaggtgctcggcatggtcgacaacgcatcgcgcgtgctcgttttcggcgtgaaggatcaggggcgcctgtcgattcgctggagcgaaggctcgtgtgaaggcaattacgcgctgccgcagcagaacaaggcgctcatgtacgagcgtgttgcgatgagctgccgcatggccggccggtaacgcgaagcggtgatcgtgcacagatgctcggtacatcctgcaatcccggcgcacacgacaacgaacacttgaaaggtatacgaatgcgcaacacgatcttctctgtcattttgtttggcgctgcggtctcgccggcccttgccatgtcggcctcggattgcgagtggggaacggaacatctctcgcgggtaatatcgctatgtactacgttaacggttactccacccctgaattcaatccatcggttccaatcggcaccgtactcgattcgagaacagtctccgcatcgggactaagcaatactctttcttgtagccagatcgccgataccatactccacggacgattattcggaacagcagaacccgtatataacacttatccgactaccattcctggtgttggggtgcgcattcgcttttcgaataacaaaaattggctcccattcactgtcaactggggtacatcgatgatcaatataagcacctcatccttgatcatcgaattcgtcaaggtcggcccgatcactgcagcgggaacgttgaagggcgaactcgctggaagttatgtgaatggaacgattcaatacaggtcgatccgcatccagggcgggatcgagatcaagccgaaggtgccgacctgttcagtcgcgaccaagcagatcgccgtcaagatgagtccgaccggcaacgacttttcgtcgaaagacttcagcggcgtcggtagcactactcccgagcgcgacttcagcattcagttgaattgcacgggcggtgacctaggcacatcgaccaacgcatacgtgacgctgaccgacaactccaattcaggcaaccgctcgaatcggctgtcgctcacaccgaactccgaggcatcgggtgtcgcagtccagattctgagaaacgggtctccgctgaattttggtccgattccagcgccccgtcgaaccccaatcagtggaaagccggaaacattccgcaaggacagggggtattcacgattccgttgaccgcgcgctatatccagaccggcacgttgaagggcgggacggcaaatgcggttgcgacgttcacgatgagctatcaatagcgggaaggcagcgaacggcgtgcatggtgcatggcacctggctgggcaggatcgctcgaagcgagcgttcgatcgcatcccgcctgccggttcgctcatcgcgccctctgcacggccagtcagctcaacgcccgttcatgccgcaaacggcctgggtgtggcttgcgcttcgcagcaccgctcgatacacggcgcaacagcaaacaacaacaactggcccctccaggaatcccggctacctcataacccgtggagccgcacgcgcacacgtgccccaccggccaacgtccgctcgtcgcactcgacacgaccgatcatccgctgtcgattgacctccacaacgagatgcccgccgaacgcgcgcaggcgctgttcgagaaggtgctgcatcaggacagatcggcgcactgacgtcgccgtctcgcgcatcgcgcgccaccgaaccgggcgtacgcgtgccccatcgtgacaccggcgcggaaacccgcgatcatcgcggttgcctgttctttcctggagaccatccacatgcctcgcatgactgtccagctatttgcccgccacgtcgcatcgatcgcggcatttgcatgcgtggcgctcggcggcgctgcgtcggccgagacgctgcggacggcctccgatatcgtcggcgcgtcgctggtgccgcttggcgcgctgccgcactcgccggagaacggcacgctcgatgcgttttgcgcgcgatatcgtgcgaagaccaccaccgaggccggccgcgacgtcgcgaggctcggctggatcgtgacgtcggaagcgccgctcggccgctacacggtcgtcacgttcgcgagcgggttcaagccggggacgagcgcgatctgttttgcgcgcaacgcaaacatcggcgtcttcgacggcacgacgctcgtcgcgctcggctacacggcacgcgcggccggctggcaactcggctcggtcgagtcgctggaaagcggtgcgctgctcgtctggggcggcgatggtccgtcggcgcccgtcggcgagctgcgcgaagagcatggcggcttgcggctgaccgcggtcgccgcggagcgcacttattgtcacggccgtgcggtcgtgcccaatgtgtacggcaaaccactcgacaaggcgcgcaagatcctgatctcgcacggctggcagccgctgcggccgcacgagaagccggacccgctggacggcgcggcgacgctcgcgaagcacgggatcatcgaagccgaagcgtgctcgggcaccggcatggggtattgcgcgctgcgataccggagcgcggccggcgtgctcggcgtgacgacggccggcggcgagccggacacgccgtcggcgaataccgtgatcgattatcaggtggcgtgccgaaagcagtaaacgtcacggagcggtgcgtcggtgcgtgtgtctgattcacgcgagacggcgcgggatacctgcatcgttgcatcgaaatcggagcaaatccgttgccgggcggctgcgtcggcacatcgaatcatcggcctttcgggcgattgacccgcaccgccccctcttaaactgacctccctttcacgcctccccggcacaaaaggacttccatgatcgacctatccacgttcgcgctgttctccggcgcatgtctcgcgctgaccgccacgcccggccccgacatgctgctgatcgcgtcgcgcagcgtgagccaggggcggcgcgcggggttcgccacgctcgcgggcattcaggccggcacctactgccacgcactcgcggccgcgctgggcttgtcgcagctcttcgtcgcagtgccgatcgcgtatgacgccgtgcgcttcgcaggcgccgcgtatttgctgtatctcgcatggaagacgttccgttcggatgcgaccgcgctgtcgcccgtcgcgtcgccacgccgccactcgaccgcgacgatcttccgccagggcctgacgacgaacctgctgaacccgaagatggcgctgttcgtgctcgcgctgtttccgcagttcgtgcaccccgagcacggttcgatcgccgtgcagattctcgtgctcgcgacggtgctgaacctgatcggactcgccgtgaacggcgcggtcattctttccgcgagccggctgagccagcggatcggcgcgcgccgccggccgtcgaagctgcctcagtatctgcttgggtcggtattcgtcggattggcggcacggcttgcggtggcggggcggcagtagtcgtagccgctgcccgattcaggtgccacccgaacggccacgttctggctaattctcgacacacccgcgtgtatccgccaccacccgcaacgcgtcgctcccgagcaagctcgccggcgtcacggtgcgacgctgccacggaatccggccgaaataccagatcctccagaagccgagcggatgaccgggattccggcgcaacaacgtgtcgaaggtctcgacgtcgccgagcacgattcgcgtcgcatcgcgtacgacttcgcgcacgaaccgcgagcagaactgccggcgcgacgcgagatcgaagcccgtgtcgtagaccacgcccgtccggcgcattgcggcgtcgacgagccgccgccgctgcgccgcatcgagcggctgcttcagccgcgcgaccacgcacgcgccgcgatcggagcgcgcaagaaatcgcgacatcgtcgtcacgcgcgacagcgggaacgtgctctcggcaacgagcggttccccgtcgcgctcgccgacgacaatacccacgtgattcgtccaggaacgcgtcgcgttcgccacttcgagaaacggccgcacggtcacgcgaatgaagacgatgtcgccgatttcgggttcgaccggcaacgaccgttcattgcgacgagaagcgccgacggagaagaaacgccgccagtccgcgccgggcgagcggatcatgagcggctggcagccggtgtcgacaaccatactgacctcgcgcaagtggatatggcacgagcatgtcagccgcggccgggctccgcatccgcttcgtgtgcgaggccaggtattcgcgccgcccggtggcggatttcgataccggcgtgaatcagcgcgcgggcgcggctgcctttagcgcgtcgcgcccagcgccacgcgcagccgctccatcaattgcgtgtagtgccgcagcacgtcgtccttcggcacgacattcgccgtcgcgaaacggtcggaccacgcaggtttccactcatacgagccgtgcacgctgcggtccccatcgggcgcctggatcagcgagcggatccgcgcatcgcggcccgggcccgtatgcatgtcgaacagcgcgtggatatacgtgtgatacgcgtcgtacacgtcgtcgtcgaacaggtagcggtagatgtggaacgtacggtcgagctcgcgcttcgcgcggatcacgtcgtccggcgagatgtccttccagtagccgatccacgtatagaagcacagcaacgcattgagctgcggcgcgaccgcgtcgtacagcgcgagccgcttctcgatcaatcgctggttggtccattgcaccagttcaaggcgcttcagccgacgcgcgacgagccagccgagacacgcgaccgacaacggcgtcagcacgcccagcacgagcttgacgatttccagcgaattccacggattgttgattggctgcatgaatggcccgacaagaagaaacgcatctgcgccggcgcatgtcccggcgcgcagcgccgcccgcccatttgcgtcgacattgaccgttagttgcttgcgcatcgaacgtcgcgcgacaacacgggcgacatgcccgaagcggcgcgatgcgtcagtctatcgggcgattgtcaccgagccgtgaccgttcgtcgacccgtcgtcgtgagtcgccgcacccgcgtcgcgttacgtcggcagcgccgacgtcagcttgaccttctgcatcggaatgtccgtcttcacgctcagcacgcccgggatgcgcgtgagggtttccatctggaagcgccggtagtcgtcgatatcggccgcgacgacgcgcagcaggaaatcgcagtcgccggccatcaggtggcattcgaccacttccggcatctgctggacggcgtcggcgaagcggttcaccgattccgcgtcctgccccttcagccacacgcgcgtgaagatcgtcaggcccttgccgactttcgcgggattcagcacggccacgtatttctcgatcacgccggcttcctcgaggagccgcacgcgccgcaggcacggcgacggcgacagtccgacctcgtgcgcgagctccacgttctgcatgcggccgtcgcgctggagcgcgctcaggatccggcggtcgatggcgtcaagtttcatttggcatccgattccaagaaattcccaaatccttcgttcgatgccaaattctccgaaaatcatggccacaacgcaacccgattcgagtcaaaaagcagacaattcctccccgaaggaggagtaatgagcagtagcgtttcaacgtcgtcagggcttcgcgacaagcccgcctatgtcgccgagatgggtcgcggattgcgcgcggcgctgcccgtcatgctgggtttcgtgccgttcgcgctcgtgctgggcgcgcaggccgcgcagaaagggctgagcctgttcgaagtgccgatgatgaccggcatgaacttcggcggcggctcggaattcgcggcgatccatctgtggacgtcgccgccgcacatcgcgctgatcgtcgcgatgtcgttcctcgtgaattcgcgccacatcctgatgggcgctgcattcgagccgtatatccgccgcctgccccgccgccgcgcgttcttcgccctgttcttcatgtgcgacgaaagctgggcgatgtcactcgccgacgcccgggcgcgctcggccacccatatcagcgtgccctattacgcgggcatctgcgtggggctctacctgacgtggatctcgatgaccacgctcggcgcggcggtcggcccgacgatcggcaacgtcgagcagtacggcttcgacatggcgttcacggccgtcttcctggtgctgctgcgcgggatgtggaaaggaatgcgcgcgagccgcccgtggttcgtgagcctcgtcgtcgcggcggccacgcacctggccgtgcccggcgcgtggtacgtcgcggccggcgcctgcgcggggctgatcgccgcgctgctgtgggagccgcgcgatgcctgatttcccggatgtcagcacggtcgcgacgatcgtgttgatggcgtcgacgacttacctgtcgcgcatcctcggctacgtgctgctgcgcaatcgcacgctgagcccgcgcatggcgtcggtgatggagaacgtgcccggctgcgtgctgatctcggtgatcgcgccggccttcgtgtcgacgcgcccggccgacctgctcgcgctggccattacgctgatcgcggcgacacgcctgtcgatcctgccgaccgtcatcgtcggcgtcgtgtcggccggcctgctgcggtacctgctcggataaacgcgggtagcgcgggtaacgcggatccgacccgccgtatggccggtctgtcgaacccgagaacgggcgcacgatgcgcccgttttcgcatgcgcgcacggtgcaaagcactgcgtggcacgcaggcgtcgcgacgggatgctagccttgcgggtgtacccgcgatgccgtctccctcattgcctacctgcgaggatcgtcccgatgcaagaaacccgcccgctgttcgatcgtgtcctgctcaccaacgacgacggattcgacgccccggccttgaagtgctcgaacaggtcgccacgcaactggcgcgcgaagtgtggatcgtcgcgccggcggaagaccagagcggcacgtcgcattcgctgagcctgcacgaaccgctgcgcgtgcatcgcaagggcgagcgccgtttcgcggtgcgcggcacgcccggtgattgcgtcgcgatcgcgatcagccacctgatgaaggatgcgcggcccgacgtggtgttgtccggcgtgaatcgcggcgcgaacctcggcaccgaaacggtgttctccggcacggtcggtgccgcgatgacgagcatgctggtcggcgtgccggccatcgcgctgagccaggccttcaccgatcgcaatgcggtgccgtggggcaccgcgcttgcgctcgcgccggacgtcattcgccggctcgttaccgccggctgggacagcgatgcgtgcctcaacgtgaatttcccggcgcggccggccgaggacgtgcgcggcctgaaggtgacgaaccaggggccggtacgctgcagggcgtcgagatcgtgtcgggccgcgatccgcgcgagatcgactatcactggctgaaactcgctcgcgcgccgcgtgaggacgatccggattcggaaacggtcgcactcggcgaagggtatgtcgccgtcacgccgctgaagttcgagcgcacgcacgaccacgcgctcgcgcaactgcggtcgcgcctcggctgatccgcgtacgcgggcagaaaagcggtcgcggcaatcgcgtgcatgattcttgcgcgcggctgtccggccgcgacattgcatcacgacatcaccgcatcgccacaacaccgcggcgctgtatccccacatcacttgcatcactgcatcactgcatcactgcatcaccgcatcaccgcatcaccgcatcaccgcatcaccgcatcaccgcatcaccgcatcaccgcatcaccgcatcaccgcatcacgtcaggttcatccccgtcgagcatcacgatctcgcccgtcacgtaatcggacgcgacgagcatcgcgaccgtctgcgcgatgtcatccggcgccgccgcccgccgcatcggcgcgcgctcgcgccagagctgctgcgcgtccgtccagtcggccgtgagcggcgtatcgacgagccccggcgcgaccgcattgacgcgaatcgccggcgcgagcgtgcgggcgagcagccgcgtcgtgtgattgagcgccgccttcgccgccgcatagggaatcgacgcgcccttcggccgcacgcccgcatgcgaactgacgttcacgacgcacccggcccgcccgtgcgacgccgcctcgcgcagcgcggcctccgcttcggcgacgagccggaatggcgcgatcacgttgatctcgtgcatctcgcgccacacgtcgggcgtcgccgcggcaaggtcgtcatgcggaatcacgcggctgacgcccgcattgttgacgaggacgtcgagccgcccgtgcacggccagtgcgtcgcggatcagccgcacgcgttcggcatcgtcggcgagatcggcctgcacgtaggccgcgccgagttcgcgcgccattgcgcgccccgcgtccgccgaactgcgcgaatgcaggatcaccgcataaccgtccgccgccaggcgcgcgcgatcgccgcgccgattcccgacgtcgatccgatgacgagcgcgaccggccgatgcagccgcgacgcgcgcggctcggcgagggtttcggtttcaggttccgtttcgggaatcggggcagaaatcggcggaagcggcgcgtccatgtcggggaaccctgtcagtggcgttcccgcatcataagcgcgacgacgtctcccagacgcgaaagtcaccgcggccaccatgagggtcgctccggcgaagccgaatcggccggccatccagccggccggcaacgcgcggattgcacagccgagatcgcatcagaaccggtacacgctcggcgagcgagcgcgcccgcctgccgggctcggccgcatcggacgcatcggacacggcggcaatcaggcccggacagaccatcgccgtgccgagaccgggcaacacgctcgccacgagccgccagcgcaaccgccccgtcagcgcggtcggcgcacgcccggccgcccgcacccgcatcccggcgacgatcagcccattgcggccccagcagtcgctcagcggcccggtgacgatccggcaactgccccacacggccggataagacggccacaaggatgccgatccgctcgaaaccggcgccgccggatgaagccaatcggcccgcgtcgatgcgggccgcttgctgttgcctgccgctacttcctgccaacgccagcgaaggtgcgagcgcgctgttcggatcctgaccgttccactggctgacccaaccatcgttcggcgtcgcccccatcacgaaatcgagcgtgccgccggccttcatctcgtcgtacgtgatgtacggccgatgcagcggcacgccgttcaggctcaccgactgcacatagcgattgaccgacgacggcgcgccgccgccggccgtgtgcgccgtcacggtgaagcgccgcgacttgccgaacttcaacgcaccgccgtctccgccgcccgatgcaaccggaatatcgagcgtcgcttccgcgaacagcggcgtgccaaggtagaacacgccgcccaccggattcagcgaatagatgccgagcgcggacagcacgtaccacgcggacagctgcccgcagtcgtcgttgccgggaatggccgaatcgcgcacgcggcgcgggtcggccagcgcggccttcaggctgtcgccgctgagcagcgcgcgatcgccggccgtcagcgtcagcgaatacatgtcgtccatcaccgtgcgcacgcggtcctgtgtcttcgacggcatgcccgcgacgtcgtacaggtacggcagatggttcgccggctcgttcccggcgaagaactggccgctgcggccggtcaggtccggaaagccctggttgccgaggaaggtcagcgggttcgccggatcgaacgtgcgatcgagctgcgcgatgaactggcttttcccgccgagcaacgcaacgagccccgggaagtcgtggaagatgttccacgtatcgatccacgcattcgattcggagaagtccgtcttctccgccgccgtcgggtcgaagcccgccacccagttgccctgcgcatccttcggctgcgagaacttccagccgttgttcagcgtcgggttgaacacgttccggtaattctggctgcgctgcaggtagggccggtagtcggccgtgctcttgcccgccgccttgccgaccgcggccgtcgcccagtcgtcgaacgcatagtcctgcgtcgtcgacaccgatgcgttgtcgcccgcatacacgtagccgcgctggcggtactggtcgaaaccgtgcgcgctcgcgccctgcgtggtggtcaacgcggtccagatgtcgtcgatgcccgcgctcgtcaggtgcttcaggtacgcatcggcgatcagcgggatcgacgggtggccggccatcgtgaaggtttccgtttgcgcgagcggccacaccggcagctcgcccttgccgttctgcctgaactgcgtgagcagcgacttgacccagccgtcgacgcgctcgggctgcaccagcgtcatcaacggcgactcggcacggaaggtgtcccacagcgagaacgtcgacgaatagtcgaagcccggattcgcatgcttgctcgtcgtcggcggcgacgtcgtgccgtcgttggtcgaatcggtgccgacgtagctgccgtccgcgttgttgtagacggtcggcgcgagcatcgtgcgatacagcgacgtatagaacatcgtccgctggtcggcgctgccgcccttgatcctgatccgtccgagcgcgtcggcccacacgcgttcggccgcgccgcgcacctggtcgaacgacttcgcgccgacttccgcggcgagattggcctgtgcatccgcgatgctcgacggcgagatgccgaccttcaccgtaaccgcgccgctgtcgttaccgtcggcgaacgtcaggtaggccttgaagccgtcggcgctgaacgcgacgtgtttcgcatcgaacggcttcgagaaacgcgcgacgaaatacgtcggcttgttgttcgcccagttgttcgtgatctcccagccggcgatcgtctgcgcgtcgatgacctggatcttgccgctcgcagtcgagccgccgatcgggttgtcgatgctgacgatcatgctgcgcttctgcgcagccgcgctcgggaaatacgtgtagcgatgcacgcccgcgtgcgcggtggccgtcatctccgcgagaatcttcgcgcccttcacgttccacggcgtgttgccgctgccgaccggcgccatcttcacgcggtagtagccggggctcgcggtttcgtcgtcgtggctgaacgacgcgttgtaggtgatcgacgcatcggcggccaccttgcccagcgtcgcggtgtcgaccggcgccagcgtcggcaggaaccgcacttcgccgcccgagccgatgccggtgcccgacaggtgcgtgtgcgtgaagccggtgatgagcggatcgtcgtactgatagccggacgtgcgatcccagttccacggcagcgtgtgggcgccgccggtcgtgtccggcccgagctgcaccatgccgaacggcacggtcgcgcccgggtacacgtggccgtggccgcgcacgccgctgccccagtccgcgttgatgtcgaggttcgccgtgccgatcatcggatcgacgctgcgcagcaccgatcgcttgcccgcaccgccgttctcgccctggtcgttctgatcgcccgggtcgttccggttgccctgcgcgttcgacatctgcgcgagcacgctcgcgtccgtcgaagcctgatcgcccccgcaccccgacaacacggcaaggcacccgatacccaccacatgacgtagcttcatccgttcgtccctccctctctgcgtcgatcctgtcggcaagaaccgctcgttgatcttctcgaccgttacggcgcgccggccgcctgcgggaacgacggcatcgcggatgcgtcggtgccccacgtcgccgcgctcgcgtcggccgtcatcgaatacgacagctttccgcccttcgcgatgtgctcgaacggcagccacgcggtcgggtaaggtgcgccgttcagcttcagcgacttcacgtagaacgacgcggcatcgcccgaacccgcgcccggcgcgacgatgtgcagcaggcggtagctgccgtcctgctgcccgacgcgcacgacgatcttctcgaactgcgggctcgacagcgcgacgccgctcacgcccggcacgaccgggtagagaccgagcgcagcccacacgtaccagcccgagatcgcgccgagatcgtcgttgccgggcagcccggccgcaccggtgccgaactcgttcgcgagcgacgcgtgcagcacgcgctgcgtatgcgacggcgcgcccgcccatgcatagacccacggcacggccatcgtcacttcgttgccgacgtagaaatacggctgcacggtgccgatgttcaggtgcgtaaagaacgtgtcgagccgcttgacgacaggtgcggcgccgccggcctgcgcgatcacgccgccgagatcgtgcggcacgtaccacgtgtactgctccgagttgccttccatgaagccggtgccgtcggtgacccacgcgcccgccgacgtcttcggctggatcgcgttcctgtcgaacaggttctgccagttgccgctcgacttcagcagcgtgccggccgtcgccgtatcgccgagcgccgtcgcgaaacgcgacaccgcgaagtcgcgcaccgcatattcgagcgtgttcgacgcggtctggttgtcgcccgggcccgacgacggcacgtagccgagccggtcgtaatccgcgcggctgcccatcaccggcgtgccggcgcatgcggcgcccggcgtcgtgctgtgcttcatgatcgacagcgccgcctgcgtgtcgaagttcgtcgcgccgaacgcatgcgcgttcgcgacgatgatcgagcccgcatcgcccggcatcacggccgtctcggtattgaagtacgcccagcgcgggaacgcgccgcacgctttgcatcgagcacgagcgactgcacgatgtcgctggtccgcaccggatcgagcaatgcctgaagctgcatgaacgagcggtcgatgtcccagccggagaagttcgcgtacatcgtgcggccttgctcgacctgacgcgtcggcgcggccgatgcgccgttcgacgcgtagaagtccggatactggccgttcacgtcgttgaacacgttcgggtgcagcgacgcgtgatacagcgcggtgtagaacttcgtcttgtcggcgtcgctgccgcccgtgacctggatcgcgttcaggcgcgcgttccacgcggcgctcgccgcgcggcgtaccttgtcgaaacgccagttccggttgccctgcgcatcggtgcccggattctcggcgagcaggttcgccttcgcattcgcttcgctgacgaacgaaatgccgagcttcatcatcacgtccgggtgcttgcggtcgacattgaacgtcaacgccacggggctgtcgttcgacagcgccggcttcaccgcgaacggctggctgaattccgcgtagtagtagacgggcaccgcatgcccggcccagcagaatccgccgcccgcgatcgtgccggacaacgcgcggtcgccgacctggctgatcgtgtcgcccgtcgagccttgcgcgcgattgttcagcacggtcggatcgatcgcgatcgtcgcctgctggccctgcgcgagtgccggatacgtgaagcgcgcgaaaccggtgcgcagcgtcgtcgtcagttcggccttgatgccgttgccgagcgtgacgccgtaatagccggcctgcgcggtttcgttcgcgtggctgaagctggcgggggtgccggcgtcgccgggcgcgagctgcggcatcacgttcaggtagccgccgttcgcccagcagccggtgccgctcaggtgcaggatgctgaatgcgttgatcgacgtgtcgccgtaccagtagccgccggagaagccggagccgtcgcctttgcggctgtcgtactgggcggtgggcgtcatcgggctccactgcatcatcccgaacgggaccgtcggccccggaacgtgccgccgcccagacccgagccgaccgggtcggccggctggtcggtcgcgtagtcggtaccgatcagcggattgacgtactgaacgacgcgaatgtcggcgttcttcttcgatgctgcgttgccgttgtcgtttccattgccgttgccgccgttgccgtcttcgttgccttgcgactgtgccgcggccgacagattcgaagcggctgccgacggcgaatcgccatcgccccgcacgaagccaagccaacacaaagcgccagcagcgccgctcccaaccccagttcctcgacatcgcctgtctccgtttcgttcttgaatcaagccgctggttcgaactactgagctttaaatcaggaatcttttcgtgacttgtcgcgtacgcggtcaatcggtcgaaactgccggacgcgtgtatttatttccgtacccggatgcccgaaaaacgtgtcggcaggtcgaaatgccggcacccgggaacggacaatgcacacaagcgtgcccaaataaacgtggtttctccaccccgtatttttacgaatttttattttgtttatctaaacaataggtaattgattcggtttttatacggaattcgacattgcgaatgcgatcggcaatcagggctgtttcggcagctcgacatagtcttcaagctcgccggcgatataaagccgcttgccgatacgcgggtattcgcagacatcgtgttcgagccgctgcccgccgacgagcagctctagcggcgcatcgccggtgttctgcaccgtatgcgcttcaccgccgcgcggaaagccgatgaaatcaccgagcccgatttcactgacgcgttcgccgatcgtgaccgagcccgtgccggacagcacgtagacgaattcttcttcgtacaggtgacggtgatactcggccgattcgtgaccgggcatcagcgtgagcaggtggataccgaattgcgtgaggccggtcaggtcgctgagttgtcgtttgagccggacggcattgggattcagcgaatgcaccgcgcgcgtcggttccatcttcgcgatatcggcggccttcagcagttcccggggaaagggagtcgacatggggatctcgcaagcgtgaatgcatcggttgaacgctgcgccggcgcggcgcgcgcagcggctattgtccgacattttcacgctggcagccgtggcatccgcaccgccgtcgcacgcggctcacacgccccgttcgtcgcgcgagcgcgtcgatgcgaatggtgcgcgccgcgctgcacgtcatcgaatgcacgaaggttgcgcccgccaacgtgacgggcgcggacgccgcaggacgctcagcgcacgtgcacgccgcgcaacgccgtcagcaacgcgacgagccgatcgatgtgcgcatcttccgtgcgccacgacgacacgctgatccggaacgccggccgcccctgccacacggtcgcgccgaaccacacgtcgcccgatgcctgtgcggcttcgaggatcgccgcggtttcgtcatcggtgccggcgcgcacgagcacctggttcagcacgacgcggttcagcacctcgtagccggccgcacgcaggccgtccgcaacccgcgccgcctgcgcgcaatgccgctcgaccatcgtcgccacgccggcgcggccgagcgcacgcaacgcagcccacacgggaatgccgcgcgcgcgagaattcgaggttcaggttcttctgcgcatcctgtgcaccgctcaggtagacggcatcgctgttcatcgcggtggcgagcgccgccgcgtcgcggcagatcaccatcgcgccgtcgtacggcgtgttgagccacttgtggccgtcggtcgtccagctgtccgcgccgtcgatgccgtccgtcagcgcgcgcttcgacgatgcgcgtgcccacaggccgaacgcgccgtccacgtgcacccatgcgccggccgccttcgcgggcggaatcagcgccgcgaacggatcgaattcgccggtgttcacttcgccggcctgcacgcagaggatcgtcatgtcgtcgagcggcggcaactgggcggggtcgatgcggccgtgcgcatcgaccggcgcgacgacgatgcgcttcatcccgaagccgagcacgcgcagcgccttcttcaccgtgatgtgcgcgagcgcggaaatcacgaccttcacttcgggcgcgccgatcaggccgtcctcgtcgatatcccagcccttgcgcgagagcagcgcgcgccgcgcggccaccagcgcgacgagcgtgcaggctgtcgcgctcgtaccgaacccgaccgcgctgccttcgggcaacgcaagcgcatcgaccacccagcgtgcggcctggcgttcgatcgtcgccgcgaccggcgaattcgcgtacgacgacgcgcactggtcccacgcgagcatcagtcgctcggccgcggcagcagccgggagcgccgcgccgatcacgaagccgaagtagttcgggccgttcgacgcgaccgtcgcggggtgccgtgctcgtcgagcaggcgcagcacgtcgtcggccgggcggcccgcgtcgggcagcggctcgtcgaaggcggcgaggccggccagcgcggccgcgtcgggaaacgcgcgtcgctcgccggttgcggccagatacgcgtgcgcgcgccggtcggcgtcggccagcagtgcaagttcgtccatgtcggttgcctcggggaaatggaatcagagttgcgagagatcttggccgagctgctgcaacgcgccgtcgatccgcttgtagtacgtgaacttgccgacgcgggtcgcccgcacgagcccggcatccgcgaggatgcgcatgtggcgcgtggtcgtggccggcgcgatgccaagcttctcggtgatgtacgtgcagcacacgccgagctcgtcgaagtcgccgtgcggctgcggcgggaaatgcttgcgcggctgcttgagccagcgcatcacggccagacggctttcgttggccagggcgctgatgcgggtaacgtcgtccatggggtgcggtttcgtttgacgtttcgaatattagctaaatgacaaaatgtgggcaatcggtttgaaggacgattgctgctggcgatgtggtgtgcacgggcgttgcgtcgacacgcgacgcaagcgcagcgggatcgctacttcaacgtttcgcgacagcccgtgtaatctgcgtcacgccgcagtcagtgcctgcgccagccggtcgatcagcgcgcgcacgcgcgtcggctgcgcggcacggcccggatacacgatctgcaagtcgacgtcgcccggcgagaagtcgcgcaggatctcgacgagcgcgccggacgccagatcctgctcgacgtcgaccagcgacttcagcgcgacgccatgccccgcgatgcaccacgcccgcacgagcgcgccgtcgttggccacacgccggccgcgtaccatcacgcgcttcggttcgccatcgatgctgaacggccattcggcatacaggtccggcccgaaacgcatcacgaggcagtcgtgagaaacgagatcgtccggatgcgttggcgtgccgtgcgcggcgagatacgcaggcgacgcacataccacgcgccgcgcgcggccgagcgagcggctgcgcagcgaactgtccgcgagcgtgccgcggcgaatcgcgaaatcgagcccctgcccgacgagatcgacgtaaccgtcgccgagatgcaggtcgaccgtcacacctggatgctcggccagaaacgcatcgacaacgggcaccacgcgctcgcgcccgagatcggccggcgcactcagccgcacgggccccgacagcgtctgcacgcccagccgcacgcggctttcgagttcatcggcttcggccagcaggcgccgcgcgccgtcgacgagcgtgcggccctcgtcggtcaggctgatcgcgcgcgtcgtgcgcgtgagcagcgccgcgccgtagtgacgctcgagcgccgtcagtcgctcggacaccgtggccggcgacagcccgacctcgcggcccgccgccgccagcccgcccttctccacgatgcgcaggaacagcgcgagattgtcgagcagcattgttcgctccttccgaaggatattttcgaagcctgcccgattatccgaaatgtccgcaagcgatacagtgcagcaacgctcgatgtcacggccgtccgccccagcgcttcgatcatccacaggaaacccgccatggaataccgcaccctcggccgctccggcctcaaggttccgtcctgagcttcggcgccggcacattcggcggcaccggcccgctgttcagcgcatggggcaacacgggcgtcgacgaagcgcgccgcctgatcgacatctgcctcgaagccggggtgaacctgttcgacacggccgacgtgtattcggacggtgaatccgagcgcgtgctcggcgccgcgatcaagggacgtcgcgaccaggtgctgatctcgacgaagacgggcctgccgaccggcgacggcccgaacgacgcgggcacgtcgcgcgcgcgactggtccgcgcggtcgaccacgcgctgcgccgcctcgacaccgactacatcgacctgctgcaacttcatgcgttcgacgcgggcacgccggtcgaggaagtgatgtcgacgctcgacgacctcgtgcgcgcgggcaagctgcgctacatcggtgtgtcgaacttcgcggggtggcagatcatgaagtcgctggcggtggcggatcggcacggctggtcgcgttacgtcgcgaaccaggtctactactcgctcgtcggccgcgactacgagtgggacctgatgccgctcggcgccgaccagggcctcggcgcactcgtgtggagcccgctcggctggggccggctcaccggcaagatccggcgcaacgcgccgctgcccgaaggcagccgcctgcatgaaacggcgagctacgggccgccggtcgacgaagcgcgcctgtacgatgtggtcgatgtgctcgacgcgatcgcggaggaaaccggcaagacggtgccgcagatcgcgctgaactggctgctgcaacggccgaccgtgtcgtcggtcatcatcggcgcgcgcaacgaggaacagttgcgccagaacctcggcgcggcaggctgggcgctgaccgatgcgcaggtcgcgaagctcgatgcggcaagtgccgtcgaagcgccttatccgtacttcccgtatcgccggcaggcggcgttcgcgcggctcaatccgccgctgcgcggtaagggaccgtagcggcgacgcggttgcgtgcctgtgtcaggccggcacgcctgcccggccaagccgcacgaccttgtcggccgcgccgatgaccgagcgccggtgggtgatcgcgatcaccgtgacatcgcgggcgagcagtcgcacgtgttccatgatgtcgcgctccgtcgcttcatccagcgcggaactcgcctcgtcgagaaacagtacggtcgggttgccgtacagcgcccgggcgatcgcgatgcgctggcgctcgccgccggacagcttcagcccgcgctcgcccaccgtcgtgcggaagccgtccggcaggccgtcgatgaacgtcaggatcgcggccctcgcagcggcttcccgcaaacgccgagcatcgtgcggccggccgagcagaatgttgtcctccaggctttcgttcagcagcactacgtcctgcggcacgacggcgaccgcaccgtaccagtcggcgcggtcgacgtccgcgagatcgacgccgtcgacgagaatgcgcccgccggtcggttcgatcgacttcagcgccagcttgaagatcgtcgatttccccgcccccgtttcgccgacgatgaacgtgacggccccgcgctcggcgacgaaatcgacatcggtcacgccgcgcccgttgccgtacgcgtagccgacatgatcgaacaccacgcgcccttcgcgcggcacgaacgccgatgcgtgcgacacctgccgctcctcgggtgccgtccagagcgccgcgaacggcacgagggccgcgcgggagcgcgcactctcgtcgatcgagcgcgcgagcatttcgaacggcaggttcagttgcagcagcaacgtgttgaacagcacgatgtcgccgatcgacagcgcaccggcttcatggcgcggcagcagcaaccagaacgtcaccgagaactggaccgcgaggcagagacccagcagcgcgagatagccgacgtgctgcagcacgtatgcgcgccagctgtcgcgctcgacgcgcgctttctcggagaaacgttcgctcatccatcgatgactgccgaaatgccgaagcgtctccatcgcattgatcgcgccgccgacgaaacgcgcattctcctgcccggcctcgatggcgcggtcgagaaacgcgcgcgagcgccgcgcggcaacgatcgcgatcgtcactgcgaccgcgccgtaggcggccgtgatggccacgacctcgaaattgatcagcgcgccgagcgtggcgagcgtcagcacgatctgaagcgtgccggggatcaggtccatcagcgcgagttgcacgagcaccgacagtgcgcggctgccgcgttcgttcgcactctggatttcagccggattgtgttcgacgaagaaggccgtggtcttcttcaggatgcgctcgaagaagcgcgtgccggtgatgaatccgagattcttggaactcgtgaaggacaggtactgcaccacgcgttgcagcgcgctggacaggcccagcaacaccgcatagagcccaaagcccgggatcagcgcatggagcacgccgcgatgcgacagcgcgtcgatcaggcgcgagaacagatagggcgcggcgacggcgctcgcactcgacagcacgacgaccgccgcgaccgtcagcagcatccagcgatcggccttccagtaggctcgcagcacctcgacaatcggattcggcgcgtggtgttcgttcatgacgcgaaaaaccggggcgacccggatggcgacagacggccgaaaagtctaacagaccgaaagcaaagacacggcggcgttcgggcggcacggcggcagcaacgcgaggccttcgaagaccggttagccctggacgctaccaaacggcggatgcccctcacattgacatatcggtaaatctcgatatactccgcgccatggaattgctcgacattttcaaggccctctcgaaccggactcgtctcgagatcttgcaaggcttgaaggatcccgtgaaaaacttccctccgcaggacgaaggggacgtgctcacggtgggcgtttgcgtcagcagcattcaggagggtgtcgggctgtcgcagtcgacggtgtccgattatcttgccacgctgcaacgcgccggcctggtcgaggtccggcgcatcggtcagtggacctactacaagcgcaacgaagcagccatcagtgcgcttgccaaggccattggcaaagagctgtaatttttgccgcattatatcgataattcccgatatctcttttatcgaaacaaggagttccaatgaaagcgctcatgctcaaatcatttggcggcccggaatcgttcgaactgcgtgacgtacccaagcccgtgccgcacgcgggacaagttctggtccgcgtccatgcgacgtccatcaacccgctggactatcaggtccggcgcggcgactatcccgacctggtgccgctgccggccattaccggacatgacgtctccggcgtggtcgaagcagtcgggccgggtgtgacggccttctctccgggagacgaagtctggtacaccccgcaaatcttcgacgggccgggcagttatgccgagtaccacgttgccgccgaaaacatcgtcgggaagaagccgccgtcactgagccatctcgaagcggcaagcctgacgctggtcggcgggacggcatgggaagcactggtcgtgcgtgcggcgctgcgcgtggggaaagcattctggtacacggtggcgcgggtggcgtcggccatgtggcgatccagctcgccaaagccatcggcgcgagggtgttcacgaccgtgcgcgcagccaacgtcgaattcgcccgaagtctgggggccgatgaggtcatcgactacgaaaaggacgattacgtcgacgccgtcatgcggaccacgggtggccgcggagtcgacgtcgtgttcgacaccatcggcggcaacaccttgtcgcgcagccccgacgcgctcgcacagcttggccgcgtcgtcacgatcgtggacatcgcacagccgcaaaacgtcattcaggcctggggcaagaacgcgagttatcacttcgttttcacgaggcaaaaccgcggcaagctggatgagttgagcgcgttggttgcgcgcggacagctgcggccacacgtcggcgccgtctattcccttgccgatattccgctcgcccatgcccggctcgaaagtccccgccacggtgttcgaggaaagatcgcgatcgcggtcgagccgtcgactcatctcgaccgtgttgccgcgtcttcatgagcctgttgcgcggatgctcgaccgttggccgtggcaccatgaaatgtagtcgtcatgggcctaccgatggtgccgcgaacgtcctatcgtagagacctgcgacgcgccggccggatcggaggcgcgcgcccttctcatcgaaaggtccgccaacatgaacgccaacgaaacaggactggccgtacgcgcggtcactgaaaacgactacgaccagtggctgccgctgtgggacggctataactgcttctacggccgcttcgacgatacggccctgccgctgcgcatcacgcagctcacgtggtcgcgcttcttcgacggctacgagcccgtccatgctttcgtcgcggagcgcgacggcaagctcgtcgggctcgtgcatttcctgtatcaccgcagcacgacgcacgccgggccggtctgctacctgcaggacctgttcacgctcgacagcgagcgcggcaagggcgtcggccgcgcgctcatcgaagccgtgtacgacaccgcgcgtgcgcatcgcgccgaacgcgtgtcctggcaaacacacgaatcgaaccacacggcgatgcggctctacgacaccatcgcggaaaaaccgggagccgtgctctaccggaaggagctgttgcgctgaaacggatgaaaatgggtgtcggaatgctggccgtctcacgtcgacaggtcacagtcgcccaggggacacaagatccgtcattccatcggatgctgtatccccacggctaccaattcaacgcgtcaatttgtgttctctcccgtacaggcgaacccaccgtcgtcgcccgacaatgaccgcccgcgctcaccccaccggccgcgccttgatccacagaaacagcggcacgcgcgcccattgcttcagttgatccgtatcggcgtggtcgggcggcggctcgcgcagcgacacgatcgcgaacccggctgcttccagcgcgtccatatacgcctgcagcggcagcgaccagccggcgaaatgcatcgacagcccgtcgcgcgtttccacgccgtcgaagtgctcgcgcccgaaatagctgcccttcagcacgaacggcgcatcgggttgcggccccgcgaagccaccgcgatcgcggaacggatgcacgagcgagatgaacagcagcccgcccggcttcagcacgcggcgcgcctcgttcaacgcgcgctgcatgtcgtcgagatccatcagcacgttgtatgccatcacgagatcgaagctggccgcgtcgaacggcagcgacgccgcgtcggccagctcgtagcgatgcgcggaatccgcatgacgggcggcgtcgagcatcgcgggcaccacgtcggtcgcggtcacgtcgtagccgagcgccttcagttcgcggctcacgcgaccttcgccgcagccgatctccagtgcgcggccggtgtcgcggccgatataggccgcgagccccgcgcggtatttccagaacgcatcgtgcccgggcttgccggcccagccgatccattggtcggcgacctgtgtccagtgttcggtgatggctttcgtgtcggtcatgcgcgctcccgcccggtgtgcgtcgttggctcaggatgcgcatggtaagccgatgcggcggaacgcgcgaccaggctgtgccgcgcggccggtttccgtttccggcggcgacgttctacagtgacataaaacaatccgcgccgccgcgcgtcgcccccgcccggcgatacgcacccgattccgaggacatcccatgccgagcatcctggccgcgcccgccaatctccccgagccccgtcgcggcggaaacgcgcatggtgcacgacgtcgcgacgctgaagccgtccgactaccgttcggcggacggcatgtcgtgggtcatctccaccatcacgccggccgcggacagcggatcgaacgtgaccggcacgacgtacttcgacaccgcgaaaggccggaccgtcccggtgcccgacgcgcggcgtcgatacgcgaatcgcggcacgtggcaggtcgtcgcgagttcgagccctgccgtgcccgccaccggccgctacgactggctgacgctcgcctggctgccgatcaaccggcggccgctgccgcaaacgcccgaacacctgtattcgccgttcattcgcggcggcacgatcgtgtatcgatggaatccggcggcggaaggcggcgagcagttcggcaacgtgcggatgatctttccggaatggacgcagcaggtagccgatgcgttgcggtctgcgccggcagcgtcgccggacggcgccagcacgtcggccgtaccgtcggcgctcgatcgcctgacagcggacacgaacccgatgaccgccgtgctcgacttcggcgacgcactgcgcgacgagccggtcgagcgaatcgtcgcgcggctgccggcgctgctgcgcgtgaaggacctgcacgaactgtcggcgatcgtgttcctgtgcctgtccggatcgcgcgccgaagaccggccgcgcctcgccgaagcgatcaacggatcgatcgcgtcgaccgacgacagcgcacgcctgctcgcgattgcatatggcgcgttcgcggccggccgggcacggccccatccgttcaacgatgcggggcaggccgcgcgtatcaacgacgtgttcggcgcgttgaagcggcggaccgcggcgctcgacgtgccggtcgcggaagggtcgccgtggtacgagttcttcacggcatatcggctcggcggggcggcgccgggtaacaacccgtgacgacaggcacatagccggtgctgccacggcggaagccggcctcccgcttgcgcgtggaaccggtcgctccggcgagccgtgcgccgtcatcgaccgtcacgtgagcggcgcaagtctgcatcggcgccgaaggccgcgacgaatccggatcaaatggattgttcgatctattcgaccatttgaaccggatcgccctgtgctagattcccgcccggccatagagccatctcaaataacccgaactaaaaagaccaaatcatgaaatctgtattccgtcatgccgctctggcattggtgacgatcggcttcctgtcgggctgcgccagcagcgtgacacgcgacgccagcgatccggcgggggccgccgtgaccgcatcgacgatgaaattcggcacgaaacccgtggtcgtgaaggtcacgctcgacaataccgcgcaggaagcgttgaaagacaacctgaagttcgacgcgaagaaactgcaggaaaaatcgaaggcgcactggacgcacgcaagctgctggcaaaagcggattcgaccgatgcaatgcacctgaacgtcgaagtcaacggcattcgcgtgcgctcgagcttctcggccgtcatgttcggcttcatggcgggcaacgatcacgtcgacggcaccgtgacgctgctcgacgccgacaatcatcagatcgaccgcttcaaggtatcggcttcgtacgcactcggcggcatcgccggcggcatggacgatacgcgcatgaactggttgtacgagaagttcaccgagcagacgctgacgacgctcgaaccggcggccggcgcacaacaggcgaacgccacgcagacgaagacgcagtaatgcccgacgcccggccggccgcggatgcgcggcccgccgggcggctgcggtcgcgctcatccgccggcgacgatgcggatgtcgcacgcaacgatcatcgtcgaccggggccttgcagcctgctcgccagccaccggccatgccccgccgctcaccgcgcgcccgcgcgcggcatgacagcatcgccgaattcctcaatacggtcgcaggccacgcttgcgtaaatactcagccatcagtcggccgatcagcaacgacggttcatatgtgttgccttcatcggaaccctgtgcccgccaccaacctggcgccacgcggtgcgcgagtgactgcccggcgcccgtatccggcgacgatcccgttccatcgaatcagccggcatgaatcggatcgcggccgagcccatccaccgccacaacgcattcacgattgcatgtgaaacgacgggaatgcagccgctcggggaaccgaccgtcaggcagagatccctttcgagacaccggcggacaccacgccggaccggcgaccgcattgtcgacgagcgattcgcaaccgatcatcagaccagcctgaacgactgcgcaccgaccgaacaatgacggcatcccgaatatgcgcacgccgcgccgggaacccgcacacatcgggccatgtcgaatcgcatcacgaccgttgaccgcatcgcgttcatcggccgatcatcatcctcctgcccccgctcgatcaagtcgcccctttcctgctcatgttaagcatcggtcccttctcgatccgcgtcgtcgcggtggccgtcgccgcgctgctcgcgtggctcgtcgcccgtttcatccagcgccgcccgccggacggccagcacaagaccgcatcgagcctgatcctcgataccttgctgctcgggctgatcgccgcgcgcatcggctacgtcgcgcagtggtggcacgagtacgccgccgcaccgcgctcgatcgtcgcgctcggcgacggcggtttcgactggcgcatcggcctcgcggccggaatcgtgttcgcgggctggcgcctgcgccgcctgcccgcgctgcgtcgcccggtgatggccggcatgctcgcgggcctcgccgcgtggggcatcgcgcagggcacgctcgcaacgttgcagcacggcgcgccgccgcttgccgcgttgcggctcgaagcgctcgacgccacgccggtgcctgcgcaacgcttcgcgggcaagccggtcgtcgtgaacctgtgggccacgtggtgcccgccgtgccagcgcgaaatgccgatcctcgcgcaagcgcagcaggatcatccggggatgacggtgctgatggtcaaccagggcgaagatgcgcaagcggtgcgcgcgttcctcgaacagaaggggctgcggttcgatcacgtgctgctcgatcgcacgctgcacgcgatgcagacctatggttcgcgcgggttgccgacgacgctcttcttcgatgcgaaaggcaatctcgtcgaatcgcacatgggcgagatcaccgccgcgcggctgaaggacgccgtcgcggaccgcttcggccagtaacgcgcgtcggcgaaaggctagggcatcgctgcgtcacatccgcgcctcgaccgcggcgagccgggtcgggagatgaacacgctgcacgcatgattcgcggccgccgtggcggaaagcacggcggtttcccgcgcaagttcgggcggccctgcacgacgcccatgacatcctcgtgcgacgtgtggcaggcgaatcggagcattcgaccgacacgctttctgacatatcgtcaataaagtgacgatgcggcccgccggcgcaatcgccggggaagcgtttcgcagcaagcctgcaagacatcggtgcgtccgtcagtgcagacgaaggcgctccagaccgacacctgatgccggccgatctcggctagagtgattgcacgttttcgcctggaatgccatttcatttcgccatgccaaccatgtgacgggatgccgatcgaaatccattgcgtaaacagcgcggcccgcgcgtgcactaccacgcgcgggccgctgaccacaacccactcagtacaggagtcagtcatggctgacgggaatcataacgcaccggttcgctttcacgattgttccatgcccgctcgcacgtcttttcagactcgccgcatcgttccacatctcaggctcgccgacacggcaccaccggccctccatctgtggatgaagctgtccggccgctggatcgacgcagcgggtttcgaacccgggcagcgcctgcggatcgaggtgatgcacaagcggctggtggtcacgccgatcgaagaagcgcccggcgacgatatcggccaggatgccgatcgctcgacaggccagccgcggccgacgttctcggtaatcacgggaggcgcgcaatgaatcgcaacgactcgcgacaacgtgccggcaccttgccggccgacttcggcctcgatgacgcgggcgcactgtcggccaaatccgcgctcgtcctgaagatcaacgcactgaccgtctcgcgcggcctgagcgaagacgaggctgcggcgctcgcggagatggcccggccggtcgtcacgcccgagcaacgcgaaagactccggaacgtctcgctggaactgctgatgcagacgctggcgtcgctgggccagcaggtggaaatcgtggtgcggcctgcggggccgccgcattcggcaggcatcacggtttcagtctgatagtcggcaaaggaacgaagggggcgtagcggccggggccccggccgccccgcgttccgacgatgcgccggacctgaccgtcagggcgcgacaacaccatcacacgacccgacacgcgctgcagcttcagccagcccgtgtcggccgtaaattgaagctgctgcagcggaaaatcgaactccgcgcgctgcgcggcgctgatcaccgcatcggcgatccagcggatcagttccttgccttcgtcggtcgtctggtggccgttctggacaccatagaaatagcggttcccggcgttgacctcgttctgaacctgcatccagtgccccggcaggccccgctgcgtcctgaacaggtcggccacccgctgcgtcgtcagtccgcgcgcccacaatgcgccgttcacggcggggcgcgccaggttgtggcgatcggcttcctgggcttgctccttgatatcgcctttcagggaatcgggtttcgtcatgacgctttcctcgcgatgggcccgacaaagggccggttgaatggacaaggaccacggagaggaggggcctgaagcgcggatctgcgcgaccctggcgtccgtggccaccacgaacgacaggccggcgacatgcgccggcctggctcacgatatcggccgcaggccggtcgtcccgcctgcgccgggtgaacgatacgcccattgcaggaattcttcgcctgtcaggtatgtcaggcttcgatatcgggcgtccgtccccatcacgctgtccttttccccttcaacaggaacgccgccgccgtacatccgaccatcgcaacacccgcgatcaggaacgtatcgctgtacgccatcaacagcgcctcacgcatcacgcgctggttcacgagcgcgagcgccagctcgtgcacgccgccggtcgcagaacccggcaacgcatcggcacgcggcacatgcacgcgcgacagcagccgcaccagcatcgccatgcgttcctgaaacgcttccgagaacggcgtcacggcctcgccgatccgcatcgcatgcagcttctgccgctcgacgacgatctggctcgccaccgcgatgccgatcgcaccgccgacgttgcgcaccatgttgaacacgccggacgccgaaccgagctgcgccttctcgatcccgtcgacggccatcaccgacagcgcgatcaccacgagcgactgcccgatcccgcgcacgacgagcgacggcacgatcacgttcgacgcggcgtcggcggtcaggtggatgttcatcaggcagccggccgcgacgagcgcgaagccgagcacgatcgtcgcgcgcgggctcgtgcggcgcatcagcggcggcgtcaggaacgacatcacgaactgcacgagcccgtacgggatcatcgcgaggccgatgtcccgcgcgctgtagccgtgcagctcggcgaagtagttcggcacgaggaacacgacgccgaacaccaccgcgccgaacaggaactgcatcaggctcgcgatcccgaagttgtagcggccgagcagccgcaggttgatgaacggcgcctcgcgccgcagctcgatcgcgacgaacgcgacgagccccgccaccgcgacgatcgacagctcgacgatcaggtcggacgcgaaccagtccttgcgcccgccctcctccagcacgatctgcagcgcgctcaagccgatcgccatcgtcgcgatcccgaaccagtcggcctggcgcagcttcgacaactgcacgggcaccgggcggatcgcccacgcgatcgccgcgatcagcgcgatcgcgggcggaatctgcagatagaagatccagcgccacgaatacatgtcggtgagccagccgccgagcgacggcccggccgcctgcgcgacattgttcgcgaccgcgaacagcgccatcccgagcggatgcttcgacggtggcagctcggtgacgatcagctggaacgacagcggaatcagcacgccgccgaacgcgccctgcgcgcgcgcgacgatcatcgtcgaaatggtcggcgcgaccgagcacgcgatcgagaacgcgaggaaccccgttgcgccgacgagcagcacgcggcgcgcggagaacacctgcacgagccagccggtgagcggaatcacgacgatctcggcaacgaggtacgcggtcgagatccacgagccttcctcgaagctcgcgcccagcgacccgcggatgtcgggcagcgacgcgttcgtcacgtgcacgttcatccccgccatgaagcagccgaacacgccgccgagcaccgcgacccacgcgcgcagcgaaacggtttcgtcgtgcgcggcctgcgcgccccgtgatgccgcggccgtcacgatccggctcccggtgcgccgcgcgtatcgacgcgcgcgatcaccgacatgccgggcctcagcacgaggcccggcggcggcgcatcgaggcggatcttcacgggtacgcgctgcacgatcttcgtgaagttgccggtcgcgttgtcgggcggcagcagcgcgaattcggcgcccgagcccggggcgagcccgagcacgcggccgtgcagcgcgcggcccgagtaggtatcgacgtcgatctcgaccggctgcccgtcgcgcatcgcgccgagctgcgtctccttgaagttcgcgacgacgtacacgtcgcgcagcggcacgaccgcgagcaacggcatcccgacctcgacgtactggcccgcgcgcaccgcccgctggccgatcgtgccgtcgcgggtcgcgcggatcaccgtgtgctcgagatcgagttgcgccagcgcgagcttcgcgcgcgacgccgcgagccgcgcacgcgcctgctcgatcgcggccgcgctttgcgcacggcgccggcgcaacaccgtctgctggtcgtcctgcgcgcgcacggccgcgccggcgcgcgccagttccgcgcgcgccttcagcgcatcggcgtgcgcctgttcccagcgctgcccgctggcggccgattcggcgagcaactgcttgtagcgcgccgcatccgcgtcgcgtcgggtcgcctcggcacgcgcggcggccgcgtcggcctgcgcctgctcgatcacgctgcgctgctggccgacctgcgcgtcgagcgtcgcggccgcggcttcctcggcctgcaacgtcgcatcggcggcggcaacggccgcctgcgcgtcgtcgagcttcgcgcgatagtcgcgatcgtcgagcacgacgagcacgtcgccgcgcttcacgggctggttgtcgtcgacggccacgcgtgcgacataaccggccacccgcgggctgacggtcacgatgtcggcgcgcacgtatgcatcgtcggtgtgctcgatgaagcggccgaccgtccaccagcgccagccgaacccggccagcacgatgacggtgatgacggcgccggcggcgatccagtggcgccgcgcgaaacgggcggatttctcgggtacggctgtggtgctcatgatcggaatcggaagggttgagtgcgtgcggattcacgaacggccggtcacggcccgttcacgtcaataacgggcttgcgctggccctgacgctgccagccgcccccagtgccttgaagacggcaacctgatcgagtgcgacctgctgcgtcgacgcggcgagcgccgcatcgaccgcgacgaggctgcgctgcgcgtcgagcacgccgagaaaatccagcgcgcccgcgtcgtagttcagttccgcgagccggaaagcgcgcgcgtgctcggcgcgcgcggtttcgagcgcggccttgtggcgccactcggcgccgtatcgcgcgagcgcctgttcggtttccttcagcgcgcgcagcacctgcgcgtcgaacgacgcgcgagcggcggcatcgtccgcgcgtgcctgcgcgagctgcgcgcggctcgccgcgagattcggaaagcgccaggtgatcagcggcccgacgccccacgcgatcgcgtacttgtcgccgagcgacgacggatcgccggtcgtcgacagccagttcaccgacccaccgagcacgatcgacggatacagctcggccgtgacggcaccgatccgcgcgttcgacgcggcgagccggcgctcgctttcgcgcaggtcgggccggcgccggagcagcgcggcgccatcgccgaccggaaacggccgcgccagcgccggcgtcgcatggcagcgcgcggccgcatcgggaatcgcgccgggcgcgtgcccggtcagcaccgccagctcatacaacgcggcgcggcgcgcgccagtcagcgccggcagttcggcacgcgtatcgtcggcgaacgcgcgcgatcgcgcgacttccagatcggacacgagaccgtgcgtgcgctgccgtgcggtcagcgcggcgaggcggtcggcgatcgcgaccgaacgctcggccacgtcgatccgctcgccgtacgcgcacgcctgcgcgtaggcggctgtcgtctcggcggccaccgtgacgcgcatcgcatccgatgccgcctgcacggcctccgaatcgtcgcgcgcggcatcgacgagatgaccgacacgcccccacagatcgacttcccacgacagcgagaacgacggcgcgaatccccggcgcgtacgtgcatcggtgcccttcgcgctcgcgacgatctggtcgggcgcgtgcttgccgtagtcgacgccgaagccggccgtcgtatcgggcaatcgcgcggcgcccgcttcgtcgagcacggcgcgcgcccgctcgacgcgcgccgcggccaccgcgagatcgcggttttgcgcgagcgcttcgcgcacgagtgcgtccagcgccggatcgtcgaacagttgccaccagcgatcgggcaacgcgccgcccggcgcgacgggcgcatcggccgcggcatcgaacggcgcgcgatgtgccgcatcgatcgacggcgggcgatacggctcgccgacggagcatgcgcccagcatcgccgcgctcagcagcgtggcggcgatgcgcggcgcgcaagacgaggcggcaacgggtaaatcgaaggaaagcgaagcaaggaaggaggcgcgcatcgtgcggtggcagtcgaacaaacgatgggcctatggtaatttcggcacattcagtcgatctcgcgcgcaaagcgcattcgtcgtcgagaaaaggacaagtggacccatttttcagcgcgctcgagcgcaaggacaagcacaagcagatcgcggtcgccgtgtccgacgcggcgtccggcgtcctgtatccgccgcattcgcaccggcacggccagctgattcacgcgatttccggcgtgatgctcgtacatgcggatgccggcagctgggtcgtgccgaccgggcgcgcggtgtgggtgccggccggcacgcagcacgagatccggatggccggcgacgtgcagatgcgctcggtgttcgtcgcgcgcgaagtgcggccgagcctgccgggcgagtgccgcgtgatcgaggtcggcacgttgctgcgcgaactgatcgtgaccgcgtgcgaactgccggccgactacgacctttcgcatcgcgcgggacgcgtgctcgcgctgatcctcgacgaaatcgaaatcgcgccgctgctgtcgctgcatgtgccgatgccgcgccatccggcactcgccgcgctgtgcacgcagctggtcaacgacccgtcggcagccgtcacgctgcagtcgtgggcgcgcgatgcgcacatgaacgagcgcacgctcgcacgcacgttcaagcgcgagacgggcatgacgcacggcgcatggtgccgccatgcgcgattgctgctgagcctgccgcgcctcgcggccggcacgccgatcctcgaactcgcgctcgagcacggctacgacagcccgagcgcgttcgcggcgatgttccgcaaggcgctcggcgtgccgccgagcgaatacttccggcggcgatagacagcgctgtccgtttcgcgacgatcgagcgctgccgcgcgtgcgcggcgcaacgtgtggcccgctacagtggcggcatcgcacgacactcgcgctccgccgatggatctgattcaacgcatgcaggttttcgtcacgctcgccgacgcgggaaccttcaccgaaaccggcaagcggctcaacctcacgaccgcgtatgtcagccgcgcgatcgcgtcgctcgaaacgcatctcggcatccggctgctgaaccgcacgacgcgctcgatgtgcctgaccgaagccggtgagcgctatctggcccgcgcacgcgacatcacgctcgcagtggacgcgagcgaacgcgaagcgcgcggcgcgcggctgcatccgtacggacgactgcgcgcgcactgcagcgccagcatcgcgaaccgtttcgtgattccgctggtcgcgcgcttccaggcgcgttatccggaagtcagcgtcgatttgacgctcgcgccgcacgtgcccgacctgatccgcgacagctacgacgtcgccatcatcgcgatgccgaacctgccgagctctgatcaggtcgcgatcgatgtcgggcgaatcggcagcgtgctgtgcgcggcgcccgcgtatgtcgcgcatcacggcatgccggatacgccgcgcgcgctcgtgcggcatcgctgcctgcagctggtcgcaccggcctacccggcaggtgaatgggcactgacgcgcggtgcggatgcggaaacggtcgcgttcgagccggcgatgacggccgacgtcgcggcatcgctcgcgatcgcggtgcgggaaggggcgggaatcggcctgctgccggaattcgtcgcggcggacgatctgcgctcaggcgcgctggtgcgcgtgctgcccgattaccgggcggacgacgtgggcgtgtttctggtgtacccgtcacgccggcacatcgacgcgaagacgcgcgcgtgggtggatttcatgaaggtggaactgcgcgatgcgcttgccgggccgcgcggcggccatcgggacggccaccaaggcggcggcgacgcgaccgcgccggacaccgccggcgcagccgccacgacgccgcttacgcgacagccttcaccgcggaatgcgcgccaaaaacgtcgcctgcaccgcttcgtccgcacgcgcatacgcgcggttgacaccgctgatcaccgcgcggatcgacgcggtcgtcaggttcgcgtcgatgccgacgccgaacgcgctgccgcgcacgcccgtgccggccagttcggcgatcgcgatcgccttcgcatcggcgccttgcgacagcgcgcgctcctcgtagtgctggatgcgcagcggcgtacgcagcgcatgcatcagcgcgtcgagcgggccgttgccttcaccgcgcagcacgcggcgctcgccgtgcacgtcggcggtcagcacgatcgtctcgcggccgtcgcgctcgctcagctcatggccgacataacgcagcggcgcatcgccttccacgtattcctgctggaacagcgaccagatctgcgcactcgtcacctcgagcccgctgtcgtcggtcaggcgctgcacggccgcgctgaagtcgacctgcaggcggcgcggcagcgcgacgccatagctctgctcgagcaggtacgcgataccgcccttgcccgactggctgttcacgcgaatgatcgagtcgtacgtgcggccgacatcgctcggatcgatcggcaggtacggcatttcccatacggcgtcgggtttctgtaccgcgaagcccttcttgatcgcgtcctgatgcgagccggagaacgcggtgaacacgaggtcgccgacatacggatggcgcgggtggatcggcaactgcgtgcattcctcggacgtgcgcgcgacttcgttgatctgcgagaaatcgaggcccggatcgacgccctgcgagtagaggttcagcgcgagcgtgacgagatcgacgttaccggtgcgctcgccgttgccgaacaggcagccctcgatccggtccgcgccggccatcaccgcgagctcggccgccgcgaccgcggtgccgcggtcgttgtgcggatgcacggacacgatcagcgcatcgcggcgcgcgaggttgcggtgcatccattcgatctggtccgcgtagaagttcggcgtgccgacttcgaccgtggcgggcaggttcacgatcgccttgtgctccggcgtcggctgccagacgtcgaacacggcgtcgcagacttccttcgcgaaatccagctcggtcgccgtgaaggtttccgggctgtattgcagcgtgaaatgcgtgtcggtcgcggcgtcggcgcagcgcttgatcgtgcgcgccgcgttcaccgcgagtgccttcacgccgtcgcggtcgaggccgaacacgatcttgcggaattccggcgcggtcgcgttgtacaggtgaacgatcgcgcgcttcgcgccgcgcagcgagtcgaaggtacgctcgatcaggtcgtcgcgggcctgcgtgagcacctcgatcgtcacgtcgtcgggaatgtggccgccttcgatcagttcgcgcacgaagttgaagtcggtctccgacgccgacggaaacgcgacctcgatctccttgaagccgatcgcgaccagcatcttgaacatccgcatcttgcgcgccgcgtccatcggctcgaacagcgactggttgccgtcacgcaggtcggtgctcatccagatcggcgcttgcgtgatcgtgcgcgtcggccacatgcggttcggcaggttgacgggcgtgaacggtcggtacttcgtcgcggggttcttcagcatcatgatgttcggtcctcggtcggtgggtcgggaaaccgcggcgcgatggccatcagtcgtggtggcaggctgcgcgcacagcggtgaaaacggtggaaagcggcacaacggcaaagcggtacggcgaacgacggccttggcggttgagcgaccgggacggagcggaacgattcggaagaaggacgaactcaggcgccggtcgacaaccggggccaggtcggtgatgcggggaaatctggcgcttcaggaaagaagcagatggaaagcgcgcagccgcagacccagcccggagaaacgggctagtagtcgtagcgagaagaggggctgggcggcttgcatggccggaatcaaatcacagggtgacgggggctgtcaacgggccgggtgcaaatgaagctgaatttgatcgctcagaatcagtcctgtccgataggcgtcgcgcagccccgtcgatatgcttcatgggtgcggcgccggtggagccctgttcacgttcggagtgagtgggtcaatccacttcgccggttgccgcaccccatttccatcgcgatcgggtttcggcgcgggcgttcggtggtggccggtgggcgcggccatgaccgagatgctgatgttgaaacgaacgctgccatatgcgaacgccgaacgtccgcgcccaagcccgattgctgtcgcctccctgcctccccgccggcgttatcgcgcatcgttcagaaaagcgatatgggcgccgatatagtttcccgaatatctgcaaatagcgccaattaaacacgtttcattaaatcgattaacctcggttttcgatttactgaacaatagccattcccggcgaatattttctgatttatttttcggcatgctcgatgcgtcgcatttcaaacggcaaacgtttgcgcgacacagctccaagccttacccatcattcctcaggaggagagcatggccgattctcaaacgtcttccaatcgcgccggcgagttttcgattccgccgaataccgatttccgcgcgattttcttcgcgaatgccgccgagcagcagcacatcaagctgttcatcggcgacagcaaggaacccgccgcgtatcacaagctgacgacgcgcgacggcccgcgtgaagcgacgctgaattccggcaacggcaagatccgcttcgaagtgtcggtgaacggcaagccgtcagccaccgacgcgcgcctcgcgccgatcaacggcaagaaatcggacggctcgccgtacacggtcaacttcgggatcgtcgtgtcggaagacggccacgacagcgactacaacgacggcatcgtcgtgctccagtggccgatcggctgacctgacgcacggccgacgaccgaccaccgccggccgcctccgggccggccggcggtcgggcaccgcatccagcggcgcctcgcgccgcactccacagaaacccgtcctaccaacggagacatccatgcccctcctttcggcttcgatcatcagtgcacccgtggcgacctcggagacctacgtcgacatcccgggcctgtacatcgacatcgccaaggcagagattcgaaacgggaaactgcaggtcatcctcaacgtgccgacgccgtacgcgaccggcaacaacttcccggcatctatttcgcgatcgcgaccgacaagggcgtcgtcgcggacggctgcttcacctattcgtcgaaggtgcccgaaagcaccgggcgcatgccgttcacgctcgtcgcgacgatcgacgtcggcaccggcgtcacgttcgtgaagggccagtggaaaagcgtgcgcggcagcgcgatgcatatcgactcgtacgcgagcctgtccgcgatcggggaaacggcggcgtcatcgtcgtcgcccgccggcggcggcaacgaaaccggtgcggacagcggcagcggtgccggcggcatcggcggcggcgagcgcgacggcacgttcaacctgccgccgaacatcaagttcggcgtcaccgcgctcaccaacgccgcgaacgaccagacgatcgacatctacgtcgacgacaacccgaaaccggccgccacgttcaagggtgccggcgcgcaggaccagaacctcggcaccaaagtgctcgattccggcaagggacgtgtgcgcgtgatcgtgatggcgaacggcaagccgtcgcggctcggctcgcggcaggtcgatatcttcaagaagtcgtatttcgggatcgtcggctcggaagacggcgccgacgacgactacaacgacggcatcgtgttcctgaactggccgctgggctgagtagcaccgccctgcccgccgtcgccacgccgcccggcgtggcgatccgctccagtgcgtcagccggcgcacgccccgcccgcgccgcaagaacgatcaaatgcccccggcgccgataccatatagtccgcccgacacactcattggcacgccatgaatccggtaggacaagcactctggtttatcgaaaccacgctagacacggaactgacgctcgacaggatctccgccagttgcgacatgtctcgcttcggcttctcgcgcctcttctcgatgaataccggctggccggtcatgcgctacgtgcggtcgcggcggctcacgcgcgcggcacgcgcactcgcgcaaggcgcgccggacatcctgcacgtggcgctcgatgccggctatggctcccatgaggcgttcacgcgcgccttccgcgatctcttcggcgtcacgcccgaggacgtgcgggcacggcgcaccctcgacggattgtctcttgtggagccgctgcgcatgaaagaactgaagatcatcgacgtgaggccgtcgcgcttcgaaaccgccggcaagcggttgatcgcgggcatgagcgaccgctatacgtttgacagcaacgaagggattccggcgctctggcaagcgttcatcccatacatcggtacccttcccggccatgtcggcgacgtgacgtacggcgtgtgctgcaaccccgatgcggacggcagcttcgaatacatcgcgggcatggaagtcacgagccgcgaccgactgcccgcgccgtttcgctgggtcgaactggcgccacagcggtacgcggtgttcgaacacgccaggcatgtctcgacgttgcaccagaccttctacagcatctggaacggctggctgccgacgtcgggattcaaggcggtggacgcacccgagttcgagcgctacagcggcgactacgatccggtgacgggcgccggcgtgctggaaatctggttgccggtcgaacctgtggcgttaacgtgaacgaacgtgacaaacaatcggaccacgctgattctgcagccaatgtgttcgactacgaagtgcccacacgatgaaccggacgggctgcagtttctcgaggcgcgggattcacagtcaggatcgtggccgcgtatgcggtctcccgacgaagttcgtttgcgaaatcagcgcctgacgccagcgtgttcacgcgaacgaaatgacgagcttcttgccgcacgctgcggcgtacttgcgcagcgtcgcaaacgacggcgagtgcttctcgctcgaaaacgaagcttcgagcctcgatactgccgacgtcgtggtgcccattcgttcggcgacctgagcctgagtcaggcccgcatccttgcgcgcgtcgagcaacgcacgaagcgcggtgaactcctcttccagtgcatcgtattccgccttgatggccggatcggtgagcagacgtgcggtgtcttcggcagtgtgtcgaaccggtgcataccgctcctcgcttgtatgtgcggggcgagccttagccattgttacgtacctccttcattcgcctgcgggcgatttgcaactcgtcgttgggtgtttcctgcgtcttcttgacgaaggaatgcaggacgacgagttcatatcccacccggatgcaatagaacacacgcccgatgccttcacggccgcgcgggcgcaattcaaacaatccttccccatcgcgcgcgaatacggcatccgcagatccgcaccgtgttcttccatcgcctcgatcagtaggaggtagccagccagaatgcccttgggcaaagcgaacacatcacgctttacccgttcgtcgtagtacaggatcgtccacttcttcatcgcgatattagcaaatttgctaactcccatcaaacctgtcgagtccttccggtcggcgcgctccgggcacgtgaccatccgcatgtattgcgactcctgcgacaaagcgacatgcccgctgccggccacgcgccccgatcaggtacctctcgtcaggccaggtgaaccgggtatccggcttccgtttatcaattcgccttctacacgcttccttcagactctaaggcgacgtctttgcgattcgtcagctaaccaaacgatctaattcccacattgcaagtccgcggggtcagccatcatgcgacggggaaagcgtcgacatcgcgaccgaccgcagccaggcggcagacgcgagctgcgtgcgcgcatcgagcgccacctggttgaacgccacgcgccgctcgcccttcagcttcgccgcgtcgcccgcctgtaccagcgcgaccgggtcgacgagacggtcatgcctgcgcacctcgaaatgcagatgcggccctgtggccgtccccgtgctgccgaccgcgccgacacgctggccgcgcgcgacccgcatgccggttcgcaacgtcggctcgaacgccgacaggtgcgcgtagtacgacgcataaccgccgtcatggcgaatcaccacgtacttgccatagccgctcggctcggtgccgatgaacgtcacgaccccacgttccgacgcatgaaccgcgcgcccggccggtgccgcgagatcgacgccggaatgcacatgacgcgcgccggtcaccggatgcacgcgcgccccgaaatgcgagctgatccgcgttgcgttgaccggcatcgcaaaccgcgaaccggcaagcggcacgccgtcgaagtcgtaataaccacccgacgcgccgtcagcgggcgtaaaccacacgcccgtgacgtactggccgcgaaagcgaagctcgagcgccgtcacgcgcgtgccgcccggctgcatcgcgctgtcgtcgggttcgtatgcgacgcggaaggtgtcgccgagtgcgccgtgctgtttcagctcgatgcgcccggcgagcatgcggatgacctgctcggcaacgccggccggcagatcggcgcgcgccagcgacgcccgcaggctgccgacgatcgcgccgccacgcgcgccgcgctcggcctcttcgagcacgaacggttcagcggcggcgagatcgacgggacgccgttcgtacgcggcctgttcacccatcgcgggcaacgccgatgcaagaccgtaatcgaacctcgacgcgtacgcgcgttcgaccgcaccgcgcgccgcatcgcacagcacgcggtaggccacacatgcaccgaagcgcgcaacggcgccatcgcgttcatgcgcgctcggcccgctcggcacggtcgacgcaggcgacgcgtaggcaacgtcgagcggcgctgccgacgatgcatgcaagccgccccacgtcgttcgcgcggcatcgaaaaagggcacgtcgacaaggtcggccgtcacgggcgaaaacggcgcggtgtcgtgggacacatgcgccgacgcacccggtgaacccgccacacaggcggccgcaacgacaccgcgcagcagcgcgcggcgcatcgggaaaccgcaagcgccgcggagcgcggatagaccttgttcgcgtgcgagacggaaacgcaggtctaaccgcatgacgtcgtcactcgctgtctgtcaatgaaaaatcgggaaagaaccgggtatcgcggaggaacgatcgtcgcgacccggcaacgtgaagacgagtgtatcggcgcgatcgaagcagctgaataggacaagtctcagttactggaaaagtcgcttcgtactagatcgaaatcgcgatgtcgtgcaccgacggcacggctgtgcggcatttgaccccacccatgcgagcgaaccatcgtgccgcaggtacagtcgaacgctgccggcgcgtgagcgcgagcgtgcccgaccacggcacgttcgcgtcgcatcgcgcacagcttcctcaacccggaatcccttcatgtttctcgaccaactacaccggaacgctggacgttcctgtggaacgcactgtccaccctctccatcaagctatgtgctggcctggcgctgctcgtcgtcggctggtggctgtcgaaacgcatcggcaactggctgaaccgcctgctctcgaacaaggagcgcgtcgacgacacgctacgaccgatcctctgcgacgtggccgtgtggggcatccgcatcgtcgcgatcgtcggcgcgctgtcgcagctcggcatcgaaaccgcgagcatcgtcgcggtgctcggcgccgcaggctcgcaatcggcctcgcgctgcaaggcacgatgcagaacatcgcggccggcatcatgctcctgctgctgcggccgttcaaggtcggcgactatatcgacggcggcacgggcgtcgcgggcaccgtcgacgaggtcggtctcttcatgacgcggctgacgaaaccggacggcatctgcgagtacgtgccgaacagcgcgctgtggggcagctcgattcgcaactacacgcgcaatccgacgcgccgcctcgatctcgaagtggaagtatcggtacacgacgacatcgaccgtgcgctcgatgcgctgcgcaagctggcgctcgccgatcccgacgtgctccgcgagccggaaccggacgtgatggtgatgcgcttcgacgacagcacggcgatcgcgaacatgcgcgtgtggacgcacaccgacaagttctgggcgatgcgctggcgcctcgcgcgccaggtgcgcaaggcgcttgccgatgcggattgcgtgctgccaatccgcgcacgcgagctgcacatcgtgcacgacgcggagcgccgcgccgacagtacgcgagtgcgcgcgctgtaaacggcgaaggccgcgaagcctgttccgcttcgcggcccccgcgacatcagacgcaacaccaacgccaggtcaccgccgcgtcacatcttcacgatatcgagcagcgccttcttgccgctcttgtacgtgaacaccgagatcgcgccgtgcttcaggtcgccctgcggcgtgaagctcgtttcgccgatcacgccgcgatagtcggtggccggcatcgcggccagcaccttcgccggatcggtcgagttcgcgcgtttcatcgcgtcgacgatgatgtggacggcgtcgtacgagaacggcgcatacacctgcatcggctggtggtaacgcgcttcgtagcgcttcgcgaacgccgcgccgcccggcatcttctcgagcgcgatgccggcttcggagcacacgacgttgtcggaggccgggcccgcgagcttcggcaggtcggtcgagcacacgccgtcgccggcgaggatcttcgcccgcatgccgagctggcgcgcctgcttcgcgagcgggccgcccgtcgcgtccatgccgccgtacatgatcgcgtccgggttcgcgcccttgatcttcgtgaggatcgcgcggaagtcgatcgccttgtcgttggtcgcgtcgcgcgacacgacctgcatgccggccgccttcgcggctttctcgaactcggtcgcgaggccctgcccgtacgcggtcgaatcgtcgaccacggccaccgtcctgatgcccatgttcttcgccgcatacatcgcgagcgcgggcccctgttgcgcgtcggtcgcgacgacgcgataggtcgtcttgaagccttgctgcgtgtaggtcgggttggtcgcggcctgcgagatctgcacgacgccgccgtcgcgatagacgcgcgacgccggaatcgacgtgcccgagttgtgatggccgacgacaccgatcaccttgtcgtcgacgagccgctgcgcgacctgcgtcgcggtgcgcggatcgcccgcgtcgtcctgcgcgtcgagctgcagcgtgaccttcttgccgccgatcgtcaggcccttcgcgttgatttcctcgaccgcgaggcgcgcgccgttctcgctgtccttgccgagatgcgcgatcgcgccggtcagcggcgcgacgtggccgatgcgcacgatctcgtccgcgtgcgcgggccatgcggccagcgcgcacgtcaatgcggccgcggtggcgagtgccgtcttgtgatgccggttcatgcctgtctcctcctttgtcgcacttcgttcgtgttcggattcgtcgttcgtcgaaggccgcgcatgcgctcacgcgcgcccttcgaatcccagcagtacgttcaccgcgttgatgccgatctcgtcgaccatgtagccgccttccatcacgaacagcgtcggcaggttcaggcgcgcgagcgccgcgccgatgcgcaggtagtcgggcgagcgcagccggaaatggctgatcgggtcgtgctcgaaggtatcgacgccgagcgagacgacgagcgcgtcgggcgcatgtgcggcgatcgcggttgccgcctggtcgagcgccgccgaataggtgtcccacagcgtgcccttcggcagcggcaggttcaggttgaagccttcgcccgcgccgatgccgcgctcctccgcgtagccggagaagtatgggtacgacaccggcgcctcgccgtggatcgatgcgaacagcacgtccgcacggtcgtagaagatgtcctgcgtgccgttgccgtggtggaaatcgacgtcgagcaccgcgacgcgcgcggcgccctgcgcgatgcagtgctgcgcggcgatcgccgcgttgttcaggtagcaatagccgcccatgtactcgcggcccgcgtgatggccgggcgggcggcacagcgcgaacgccgcgcgcgccgcgccgctcgacagcaggtcggcgccggtgagcgccgagttcgcgctcgcgctcacggcgtcccacgtgccggcgttgatcggcgcgccggcgtccatcgcgtagaagccgagcttgccgtcgatgaacgcgggcggcgtcgcggcggccggcatcgcgcgcaccggccacacgagcggcagcgcctggcaggtgcggcccgtcgcggcccactcgtcccacgcgccggcgaggaaatcgacgtagcgcgcgctgtgcgcggccgcgtagtgcgcgcggtcgaacggtttcggcgcgatgacgtcgccaagtcctgcggcacgcacctgcgcgagcaccgtctcggcgcgaaggggttttcgaacgaatcggtgatcgcgccgtccttcagttcgacgccgcgatgcaattggtgatcgctgctgtagaccgtgagcatggttgactgttgcggtgagggtggcaacagtttattgaccgcaggcggcaataactttgctttcgacgcgtgcctttcgtacaattttgagaaaaccgcctacggaatcccgaaaatgagcaaaattcgcgcttcggtcgaactggatggcgtggaccgcgccatgctgcgcctgctgcaggacgacggcgcgctgtcgaacgcgacgctcggcgagaagctgtcgctgagcgtcacgccctgctggcgccgccgcaagcggctcgaggacgaaggcgtcatcaccggctaccaggcgaatctcgaccggcgcgcgctcggcatgaacgtgttcgcgttcgtgcaggtgacgttcaacatgcattccgaccaggattccgatcacttcgaggaggtgatgcgacggcacgacgaagtgacgtcgtgccacaagattaccggcgcggccgactacatcctgcaggtcgtcgcggccgatctcgatgcgtacgccgaattcgtcgagcgcgtgctgcgcaagcaggccggggtttcgtcgatccagtcgagcctcgcgttgcgcgaagtgaagttctcgtcgcgcgtgccggtaccgggcgcctgaacgacgcggcgaacgcaggggccgtcagccgattctccgaatacccatcccatggagcaccacccatgaagcgtttcgtcccttccctgtcgctggccgccacgctggcctgcgcgttcgcactgagcgcctgtgccgcaccatccacgccgccggcccaatcgtcggcgccgcccgccccgccgatggtcggcagcgatcgcgacgcgcatggctgcatcggttcggccggctattcgtggtgcgaaacgacccaacgatgcgagcgcccgtgggaactcgcgaagcagaagggcttcgcgaattcggcgcaagcgtacgaccagttctgccggaacggtgccgccaagtaaagtgacgtgacgtcgcgcgatcgtgtcgcggcacactgccgcgacacgacgagacacgagcaagacgctcccgaaaacccctcgcgatcccgcgcagttatccacacgtttcccggttccgccgaccgtcattccggaaacccggacacgcaaaaaccccacgaaaacaacggtatttttcgtttgtgacacagcaaacgagttcggttacattacgcgccccttgccaccccgcccccgcaaaacgcgtcgcgcgcggcctctttccacgcagcctgaagcgctttccgccgaggcttgccgcaagggcccgggcgcgtcgtgcgccactgtgacgcaggcgcttgcctgcccgcgggcagccgatccgaaggtgtccttcccgacggtttcgcgtgcgcaaatgcaacgcggcgcggcgtcgatccgaattccggattcgcgatccggatctccggatccgcgtttcaccgcggtcgacacgcacgccgggcggcttggcaaaccgatgcatccaagttgaaaaagggatctgctgtgatcaaaacgttacgggtaatactgtcggcgctcgcgctgtgcgtcgccgcgtcgtccgcgcacgccgccgatacgaagaaggtcgacgtcctgctggtgggcggcggcatcatgagctcgacgctcggcgtctggctgcacgagctccagcctgactggtcgatgacgatggtcgagcgcctcgacggcgtcgcgctggaaagctcgaacggctggaacaacgccggcaccggccactcggcgctcgccgaactcaactacacgccggagaaggcggacggcaaggtcgacatctcgaaggccatcgagatcaacgagtcgttccagatctcgcgccagttctgggcgtggcaggtcaagcagggcgtgctgaagaacccgcactcgttcatcaactcgacgccgcacatgagcttcgtgtggggcgacgacaacgtgcgcttcctgaagaagcgctacgaggcgctgcaagccagcccgctgttccgcggcatgcagtattcggaagactacgaccagatcaagcagtgggtgcctctgatgatggaaggccgcgaccgcaaccagaaggtcgcggcgacgtggacgccgatcggcaccgacgtgaacttcggcgagatcacgcgccagttcgtcggctacctgaagacgcagccgaacttcacactgtcgctgtcgagcgaagtgcgcgagatcacgcgcaatgccgacggcacgtggcacgtgacgtgggtcaagctgcactcggatgaaccggcgcagtcggtcgacgcgaagttcgtgttcatcggcgcgggcggcggtgcgctgcacctgctgcaggcgtcgggcatccccgaggcgaaggactacggcgcgttcccggtcggcggctcgttcctcgtgacggacaaccccgaggtcgtgaagcagcatctcgcgaaggcgtacggcaaggcgtcggtcggctcgccgccgatgtcggtgccgcacctcgacacgcggatcatcgacggcaagaagatcatcctgttcgggccgttcgcgacgttctcgaccaaattcctgaagaacggttcgtacttcgacctgctcaagagcaccaacacgcacaacgtcgcgccgatgatgcgcgtgggcgtcgacgaatttccgctggtccagtacctcgccggccagctgatgctgtcggacgacgaccgtttcaacgcgctgaaggaatatttcccgaacgcgaagaaggaagactggcgcctgtggcaggccggccagcgcgtgcagatcatcaagcgcgacccggtgaagggtggcgtgctgaagctcggcaccgagatcgtcagctcgcaggacggcagcatcgctggcctgctcggcgcgtcgccgggcgcgtcgacggccgcgccgatcatgctgaacctgatgaagaaggtgttcaaggacaaggtcgcgacgcccgagtggcagcagaagatccgccagatcgtgccgagctacggcacgaagctgaacgacagcccggcgaaggtcgtcgaggaatggacctacacgagcgacgtgctgcaactggcgccgccgccgaagatcgacatggcgacgccgtcgcagacgacgggcacggccccggcacgccccgcgaaggcgtcggccgacatggcgctgtaacgcgtccggccccgattcgccgcaccgcacggccaccctccggggtggccgttttgcatggcggatgcggatgccgtggcgtgcttcgtcctgcggaggcttcgccggctgccatgccgcccgccgcgccgctgccgatcgtccgccaccggccgcccgctgccggccgcccgctaacggccgaaccgcagccggtcgccccggccgctcgcccgctacgagccgagcgcgtgcggccgccccagccgcccgcccgcatccgctagaatgcgggcacgcgcgacgccgtcgccaccgatccaccatccgcatcgacgcggtccacgcgaccgccggtgcggcccgcgcccgagccgcgcgagcgccgcacctcgttgccgcgcccgccgggcgcgccatcaaccgaattcagctggagaaaatccgtgtttacctgccgaaaccagagctgcggcacgcagtgggaacagtccgacgtcgtcatcaaggacgaaggccaggggctgctgttccgctgcccgctgtgcggcgcccgcaactacctcgagcgcttcgaggacgatgaaggcaacgtcgcctacgaacagatggaaggcaagccttacctcggagacctcgaatgacccagccgaccgccacgcccttcagcgcgctgccgctgacgccggccacgctcgccaacctcgcccagctcggttatgtcgacatgacgccgatccaggccgcgagcctgccggtcgcgctggccggccaggacctgatcgcacaggcgaagacgggcagcggcaagaccgccgcgttctcgctcgcgctgctggcccgcctcgacgcgcgccgcttcgacgtgcaggcgatgatcctgtgcccgacgcgcgaactcgccgaccaggtcgcgcaggaagtgcgccgcctcgcgcgcgccgaggagaacgtgaaggtgctgacgctctgcggcggcacgccgatgcgcccgcaggcgcagagcctcgagcacggtgcgcacatcgtcgtcggcacgccgggccgcatcatggatcacctcgatcgcggcaacctgaagctcgacgcgctgaacacgctggtgctcgacgaagccgaccggatgctcgacatgggcttcttcgacgacatcgcgaaggtcgcgcggatgtgcccgaccacgcgccagacgctgctgttctccgcgacctatccggacggcatcgtcaagctgagccagcaattcctgcgcaatccgaaggaagtgaagctcgaggagcgtcacgacaacagcaagatccgccagcgtttctatgaagtgacggagaacgagcgtctgcatgcggtcggccagttgctgaaccattaccggccggtgagcacgatcgcgttctgcaacacgaagcagcagtgccgcgacctgctcgacgtgctgcacgcgcagggcttccacgcgctcgcgctgcacggcgagctcgaccagcgcgagcgcgaccaggtgctgatccagttcgcgaaccgcagctgctcggtgctggtggcgaccgacgtcgcggcgcgcgggctcgacatcgcgcagctcgaagccgtgatcaacgtcgacgtgacgcccgatcccgaagtgcacgtgcaccgcatcggccggacgggccgcgcggatcaggacggttgggcgctgagcctcgcgagcatggacgagatgggccgcgtcggtgcgatcgagcaggcgcagaagcgtgacgtcgaatggcatccgctcgcggaactgaagccggccgacgacggcgtactgacgccgccgatggaaacgctgcagatcctcggcggacgcaaggacaagatccgcccgggcgacgtgctcggcgcgctgaccggcgacgccgggttcgacggcaagcagatcggcaagatcaacgtgaccgagttctcgacctatgtcgcaatcgagcgcggcgtcgcgcgcgacgcgctgcgcaagctcaatgcggggaagatcaagggcaagcgggtcaaggtccgcttgatggacgaggagtaagccccgcgcgcgccgctacccctgcgcggcgcgctcgcccagcatcgtcaggtactgctgtaccgcccccattccgcgccgagccggctgagcgcgacgagctccgaccgcggtgtatcgccggcaagcttccggtacacgacgttcggcgccgcgatccggctgagcggcgccggcacgatcgacacgcccaggccggcccccgtcagcgccagcaccgacagcgtgctgctcacctggtgcgcgatgcgcggctcgcgcccgagcacctggcgcaggatcgccagttgcccttcgtcgtcgccatcggccgcatacaggatgaacggttcgtccgcgagcgcggcaacgctcaccgagcgccgcttcgcgaacggatgccgatcgctcatcacgacttcccacgaccagctgccgaccgtccgcacggccagtttcgcgtcgaaggccacgccgaacgccgggcaatagccgatgtcgagccggcccgcgagaatcgcatcctgctgcgcggccggcgccatttcgtgcaggtcgagcaccacgcccggccaggtcgcgtgaaactcggtcagatcgtgggacagccgccccgtcgcgaccgcattcccgacgaaaccgatccgcacgatgcccgtctcgccgcgcgccgcgcgctggaccagcgtcttcgcgcgctcggcctgctcgagcgtgcgctgcgcctcgatcaccagcagccggccggcatccgtcagcgcgaccttgcgcgtgctgcgctcgaacagcggcgtgcccagttcctcctcgagcgcgcggatctgctggctcaacgcgggctgcacgatatgcagccgctccgccgcgcgaccgaagtgcccttcctcggcaaccgcgagaaagtagcgcaaatgacgaagatccatggggccgattaatcactcaaaacgatcaatatcgaaatttaatctattggattgaaaaatcaagcgcgcgcatcctgacggccagacgctgcaccgcagcgcaccttcacaggagccgcatcatgtccgaccgcaaccgcatcgatgtacaccagcatgtcgtcccgccgttctgggccgccgccctgcccgcccacggcggcgacccgtccggctggggcagcccgacgtggagcccggaaagcgccatcgcattcatggattcgctggagatccagaccggcgtgctgtcgttgaccgcgccgggcgtacagggctggaacggccaggcgaagtgcgacatggcacgccaggtgaacgagtacgtcgccggcctcgtcgcgaaatggccgacccgcttcggaaacttcgcgacgctgccgctgcccgacgtcgacggcacgctcgccgaaatcgaccacgctttcgacacgctgaaggccgacggcgtcgtgctgctcagcaactacggcggcacctatctcggcgatgcggcattcgaacccgtgtgggccgcgctcgaccgtcgccacgcggtggtgttcatccacccggccaagcccgcgatcgacgtgctgcccggcatgcccggcccgctgctcgactacccgttcgacacgacgcgcaccgcgctgcagctcgtcctcaacggcgtgatcacgcgccacccgaacgtgcgcatcatcctgtcgcatgccggcggcttcctgccgtacaccgcgtaccgcttcgccgaactcgcgccgggcgtgcgcaacgacgtgccggatcgcgacgggctgctcgacctgctgcgctcgttctacttcgataccgcgctgtcgtcgccgtcagcgctgccgagcctcaccgcgttcgcgcaacccgatcgcgtgctgtatggcagcgacttcccgtacgcgccgccgtcggtcagcacgtcgttcacccatgcgcaggatgcgtatgcggcgctgagcgccgaccggcatgccgcgctcaaccgtgcgaacgcgctgccgctgttcccgcgtctcgccgcgctcgcgcggtaacgcgcgatgaagtgccgcgtgacgcgcggcgatggcggcatcacgcgtgcaaccggtggccggcccacgccgtcaggtcagaacggaatgacggccttcgcccacacggcctcgccggccggccggttgcggacgaaaaactccttcacgatgcgcgcttccacgctgatcttgctgaactgatagcgaaccccggcccgatcgcgaacgcctgcccgcgaaacccgtcgcccgcgaccggccggccgttctgcatgtcgtcggtggtctgcttgacgaagtagcccgacagcccgacccgcgccttcggtgtcaccgcatagctcgccgaatagtcgacgtgaaacaggttccccgagtggtaatgcgtgtcgttgttcggcgagttgaagctgtacgtgatcttcgcggatacctcgaccttgtcgttcggcagccacgacacgccgaataccggccgcgcggtgtagtagttcttgcccgtgttcagcgcggattgcgcgtcgtactgcccggtcgggaacacgaactcgaccgccgcgacggtgcgcaacgcgcccgagccccatgcgatcagcgcgggactgacgatcaggtcgccgaggttggtgcggtcgaacgacgcgccgcccgcgtcgagcgcaagatgctgcatcggcagtaccgcatacgcgccgtagcgcccgccgagcaccgacaggttcgacatccagaccacgcgcggaatcagcacgtccgcatcgagcttgaagcccggcaccgagccgttgccgtgcgaatcgttgaagcgcgatgcatggtagtgcgtgtagtacagcaacgcgtacagcccggccggcggcagcgcgccggcgaagaacgcttccgcgccctcgccgatcgtgtcgccgccgccctccgtcgcgcgtgcgcccgtgctcagcgccatgcccgcgcaagccgcgagcgagatcagtccgaatgcagcctttcgtttcatcgatgtctccaatcttcgttctactgatttgatttattgtggtcgtcctgcgctgcctgccctgccgatgcgttactcgttgaagtggtcgatcacgagccggttgaagcgcgcggcatgctcgatctgcgtccagtgcccgcagcggccgaacacgtgcagctgcgcgttcggcagccattccatcagcttcagcgaactctcgagcggaatcacgcggtcctcgcggccgtgcacgatcagcgtgtcatgcgtcagcgcacacaactgcgtctcgtcgctcgcgagcgcatcgacccagcgctggcgcggcgcgggaaacatgttcgcgaacgcttcctggtagccgggccgcacgctcgcgtcgtagcgcagcttcgcgagctcatcgttcacgagcgtgcgatcgaacgcgaagatgtccagcagcgcgcgcatgttcgcgatcgacggcgtgtaaccccacaccgcgtcgagcccttcggtcagcgtgaagcgcgtgccggcggcgcccatcagcacgagcttgccgacccgctccggcgcgcggatcgcgagtgccagcgcgagcgcgccgccgaacgaattgccgaccacgtgcgcgcgctcgacgtcgagcgcatcgagcaagcccaacgcgtgatcgacccagtgcgccatcgaataacggtatccggccgggcgttcggtttcgccgaagccggccatgtccggcgcgatcacgcggaactgccgcgcaagcgccggcatcgtgagccgccagttcgcataggccgtgacaccgggccccgagccatggatcagaagcacgggcgggccgtcgccgacgtcgtgataattcgtgtcgatgccgccggcgacgatccggcggccgatttcaggattggatgacatgacgctccccagtcgattcatgtagacgcggcgcatcagcgcccgcgctgcttcgcgctctgcccgccgatcccgaaatgcgccttcggcatctcggtgatgatcacgcgcaccgattcgaccggtgcgtcgagcgagcgatggatggcttcggtgacctcggcgatcaggcgttccttcttgtcgtcgctgcggccttccaggatgtacagatgagcaaccggcacgatcggcctcccgtcagatgaaacgcaggccgaccgacccgatgtcctgcacgcgcagcgtcacgctgtcgccggccgcgacggccaccgcctcggtgatgccgcccgacaggatcaggctgcccgccggaatcgattcgccgcgcgcgccgagatggttcgcgagcatcgcgatcgcggcggccggatgcccgagcacggccgcgcccgcaccgaacgcgaccggcagcccgttcttctcgagcacgacgccgagcgtgcgcagatcgacgccgtccaccggcaacgggcgcccacccgccacgaagcgcgcggccgacgtgttgtcggccaccacgctcttcaggtcgaacttgaagtcgcggtaacggctgtcgatcacctcgatgccggcgatgacgaaatccgtcgcggcgagcaccgcaccgatgtgacaaccggggcctttcagctcggccttcgtcacgaacgcgatctcgggctccaccttcgggtgaatcagcgcggacgtgtcgcactcgccgccgtcgggcaggtcgtagagatcggtgaggaagccgaacacgggcgtatcgacgcccatctggcgcatcttcgcgtgcgaggtcaggccggccttgtagccgacgatccgtgcgccgcgtgcgagctgccggcgtcggatcgcgtcctggaccgcgtatgcgtcgtcccagtccatttccggatgccggtcggtgatcttcggcgtgtcgcgcgcttcgcgcatgcagtcgtcgagatgcgcggcgagcgattcgacagtctcgttggtcaggttcatgcagcctcccgcttcgcttgcgccgcgcgcgccttcgcgagcgtcaacgccgtgtcttcgatcatgtcttcctggccgccgaccatcccgcgccggcccagctcgacgaggatgtcgcgcgccgggatcccgtacttgtcgcccgcacgcttcgcaaaagcaggaacgacccgtacacgcccgcataaccgagcgtcagtgcatcgcgatcgacgcggatcgggaaatccatcatcggcacgacgagatcctcggcgacgtcctggatcttccacacgtcgacaccggtctcgatgcccatccgctcgcacacggcgacgaacacttcgagcggcgtgttgccggcgccagcgccgaggccggccgccgcgccgtcgatccggttagcgccggcctcgatcgcggcgatcgagttcgcgacgcccatcgcgaggttgtggtggccatgaaagccgagttcggtatccggctgcagcgcgtcgcgcaccgcggcgaggcgcgccttcacgtcgtcgggcagcatgtagccggccgaatcggtgatgtagatgcagttcgcgccgtacgactccatcagcttcgcctgcttcacgagcccttccgggctgttcatgtggctcatcatcaggaagccgacggtatccatgccgagcttgcgcgccatcgcgatgtgctgctcggacacatcggcctcggtgcagtgcgtcgcgacgcggatcgtctgcacgccgagcgcatgcgcctccttcaggtgatcgacggtgccgatgcccggcagcagcagcgccgacaccttcgcgcgcttcagcagcgggatcaccgcgccgaggtattcggcatcggtgtgcgcggggaagccgtaattgaccgacgagccgccgagcccgtcgccgtgcgtgacttcgatcagcggcacgccggccgcatcgagcccggtcgcgaccgcgcgcatctggtcgagcgtcatccggtgacgcttcgggtgcatgccgtcacgcagcgtcatgtcgtggacggtgattcgcttgcctttgagattcattgccgtttccttgttcgtccggtcatgggagaagcgcgcgtcaggctgcctgtgcaaccggctggagcgcgaggcggccggccagcagttcctcggcgaacatctcggcggtgcgcgcggcggcggccgtcatgatgtcgaggttgcccgcgtatttcggcaggtagtcgccgaggccttcgacctcgaggtagatcgacacgcggttgccgtcgaacaccggcccgttgacgatccggtagcccggcacgtagcgctgcacgtcggcgatcatcgcgtgcaccgattcgacgatgcgcgcttcgtcgggcgcgctttccgtcaggcaatgcacggtgtcgcgcatgatcagcggcggatcggccgggttgatcacgatgatcgccttgccggcctgcgcgccgccgacctgcgcgaccgccgccgccgtcgtgcgcgtgaattcgtcgatgttcttgcgcgtgccggggccgaccgagcgcgacgacacggtcgcgacgatctcgccgtacgcgaccggctgcacgcgggacaccgcgcgcaccatcgggatcgtcgcctggccgccgcaggtgaccatgttgacgttcatctcgccggagccgatgtgatccttcaggttcacgggcggcacgcagtacggccgatcgcggccggcgtcaggtcgatcatcagcacgccgagcgcgttgagcttgcggctgttctccgcgtggacgtatgcgctcgtcgcgtcgaacgcgatctgcacgccgtcggcctgcacgtgcggcagcaggccgtcgacgccttccgcggtcgtcttcagcccgagttcgcgcgcccgcttcaggccgtctgaatcgggatcgatgccgaccatccagacgggttcgagcacggggctgcgcatgagtttggcgagcaggtcggtgccgatgttgccggggccgatcagcgcgcaacggatctttcgggtcatggggatgtcctcgttttcgattgaatggaaacggcgccgctcacgcgaaccgcaccgaacacgcgccgatcccgccgatcgacacgcggaagttgtcgccgggcccggccggcgccatcgcggcaagcgcaccggacaggatcacctcgccggccttcagcggaatgccgaggcggccgagcgtattggcgagccacgcgacggcgttcaccggcgagccgagcgcggccgcgccggcgccggtgccgatcacgtcgccgttcttctcgagcaccatcccgcaggtcgagagatcgacgcggcgcgtgctcaccgcctggtcgccgagcacgaacacgccgcacgacgcgttgtcggccaccgtgtcgccgatgcggatcttccagtcgcgaatgcgcgaatcgacgatctcgaagcacggcatcacgcattcggtcgcggccagcaccatcgcgttcgtcacgccggggccgagcaggtcgcgcttcagcacgaatgcgatctcgccttcggccttcggctgaatcagcgtgtcgagtgcgatgcattcgccctcgccgaccaccatgcccgacagcaggtagccgaaatcgggctggtacacgccgagcatgtccatcacggctttcgacgtgacgccgatcttcttgccgacgacggtctcgccggcgtccaggcgacgctgcacgaagcgctgctggatccggtacgcgtcgtcgatcgacaggtcctcgtgctgcgacgtcagcggcgcgacgggcaggcgcgacgtcatcgcgtcgtacagccggtcgcccagcgtggtaatcaatgtggagtccataagcgttttccggtcggtaacggggatcaaagcttgatgcagacgttgcggagttccgtgtagaactcgagcgaatgcacgccgccttcgcggccgatgcccgattgcttcgcaccgccgaatgcggtgcgcaggtcgcgcaggaaccacgagttgacccacgcgatgccgacgtcgatcgacgcggcgacgcgatgcgcgcgggccaggctggtcgtccagatcgcggtcgacagcccgtacacgttcgcattcgcgcggccgatcacctcggcttcagagtcgaacggcatcacgagcgtgcacgggccgaagatttcctcgcgcgcgatcggcgaatcgtcgccgaggccggtccagatcgtcggctgtacccatgcgccgccgcgcaggtcgtccggcaggtcgggcacgccgccgcccgtcacgaccgtcgcgccgagttcggtcgccttgcggtagtacgacagcaccttgtcgcggtgttcctggctgatcagcgggcccatgccggtcgtgtccgcttccgggcggcccggccgcagcgcctcggcgcctgccttcagcgcggcgacgaaacgctcgaacagcgggcgctcgacgtacacgcgctccgtgccgaggcacacctgcccggcattcgcgaagcacgagcgcaacgtgccctcgacggccgcgtcgaagtcgcaatcggcgaacacgatcgccgcgttcttgccgcccatctcgaggctgacgggccgcgcgccgtcggcggccgccttcatgatcgccgcaccggtgcgcgtctcgccggtaaacgtgatcgcgttcacgccgggatgggtcgtcaggaattcgccggctgaatcgggcccgaaaccgtgcacgacgttgtagacgccgcgcggcacgcccgccgcgttcatcacttcgccgagcagcgcggccgtctgcggcgtttcctccgacggcttcacgaccacggtgttgccgcacgcgagtgccggcccgaccttccacgtcatcagcagcaacggcaggttccacgggcagatcacgccgaccacgccgaccgggcggcgaatcgcgtagttgagcgcgcccgcgccgtccggcgtcgccatttcgaaggtttcgcccggcacgttcttcacgatgtcggcgaacaccttgaagttcgcggcgccgcgcgggatgtcgatatggctcgcgaggctcaccggcttgccggtgtcggccacttcggcctcgagaaaatcgtcgaagcggcgcgtgatgccatcggctaccgcgtacagaatctcgacgcgctgtgcgaccgtgaagccgccccacggccccgacagcgccgcgcgcgccgcgtggacggccgcgtcgacgtcggcgcggctcgcttcggccacgcgcgcgatcaccgcgttgtcgagcggcgagcgcttgtcgaaccagcgttctccggcgcgatagctgccgtcgatgaaattgcggacgagccgcacgtccggctgcccgccggcggggccgcgcgtcgcggcgatgggttcggtgtcgtacatgatgtgtctgtcgagtgtcttgaatccgtgatccggtgggttcgttccgtgcgttcgcgtgccgtgcgtcatcgcgcgcggaagccggcggcagcgaggcccgcgtgcgcgcactgttcgtcctgcgcctcgctgccgcccgacacgccgatgccgccgatccgcacgccgtcgtcgtcgatcggcaagccgccgccgaacgcgacgaagcgtgcgcgcaagacgagcccctgccgcaccgcgtccgaatgcgtggccagcgcgtcgtgccagccgccggtcggcacgccgaaactcgcggccgtgtacgccttgtcgatcgcgatgtcgatcgaatgcagcggcgcgccgggcatccgcacgaaggccgcgagcagccccgccgcatcgaccaccgcgacgttcacgcgcacgccgagccgttcggccgcttctgccgccgcgtgcgcggcgcgcgcggcggccggccagtcgatcgtgcgcaacgcgacgctgcgggtcgaatcgttccgtgccatgacgctgtgctccttcgcgggtcaggtgtagacggtcgtgaacgcttcgttcagctcgccggagtggaagaagatcccgcgcccgagttcgtcctcggtccatgtcgtgaccgggcgatcgggttgcgcgagatagccgagccccgcgaaggtttcgttgcggttgccgctcggatcgaagaagtagatggtcgtgccgcgcgtaatgccgtgccgcgtgggcgcgacgtcgatcttcaccttgttcttcgccatcacgtcggccgacttcagcacgtcggcccagtcgtcgaggaagaacgcgatgtgatgcaggccgttgcgcgggccgccgacgaacgcgatgtcgtgcggcgtcgagctgcggaacatccacgtcgcggcgcgaatcgtgttgcccgggccgaccatcacctgctcggccagatggaagtcgaggcactcggccatgaagcgcgtgttctcctcgacacggttcacgccggtctcgggattcagctcgcacatcagcaggcaatggtcgagccagtgcacggccgagcccggaatgtcgtcgggccaaggatcgggattcagcgaaccgacggccgtgccgacctgctccttctgcgcgaacaggcgcaattcatgcccgctcggcagcaggaaccgcagctggcggcccacggccggcaacgcgccttccggcagcatctcggtcttgatcccgtacgcgtcgatccgctgccgcagcgtgtcgaggtcggcatcgcgctcgaccttgtaggccgcatgcttgagcccggcctggtcggacggcgacaggatcagcgaatagcggtcccattcgtcccagcatttcaggtagacgttgccggccgcgtcgcgcatcgtctcctgcatgccgagtacgcgtatgtaatgacgcagcgctgcttccatgtccatcaccttcagattgacatgaccaatacgcatcacactcatggtgagtctcctccttggttacttgttgagttccggcgtcccggcacaggccgatccgcagaaaaacggcttcttcagccggccggccacttccagttcgacgtcgccgtcggccgtcacgcggcacgcgagcgcataaccgtcgtcctcctcctcggcgctcacgtgcgcgcgactgaccggtccgagcttgcgcaccgcgccgcgcagcacgcgcaccttgcacacgccgcacccgccgttcaggcagccgaccgggatgccgcgccggccgagcttcgccatgccggccagcagcgattcgccggcgccgcatgcgtagcgctcgtcggtctgcgcgatcgtcaccgtcgcgcacacgcggcccgcgtccacgtcacacccgccggaacagcgggctgcgcgtctgctgcgcgtcggccgccgaaatgaacttctcgtgatagatgtcgcgctcgaacaggcgcccctgcatcagcgcggtgatgcacgcgtcgatcatcgcgggcggcccgcacaggtaggcttgatggccggagaagtcgccgtcgaaatgcgccttcgcgacgtcgtgcacgaagccgttcgcgacgccgtcacccgcgtccggtgcgccttccgacagcgccggcacgtacgtgaaattcgggtagcgttcggccagcgcgcggaattcgtcgtggtaataaagctccttcgcgttgcgctggccgtagatcagcgtgatcggcgcggtaacgccgctcgcgagcaggtcggcgatcatcgagcgcgggctcgacagcccggagccgccggccatgaagatcatcggcagcgcggccgagcggcgcacgaagaaacggccgtacgggcccgacagccgcacgcggtcgccggtcgccagctgctcgtgcaggtagccggtgcccaggccgcccggcacctgacgcacgttcagctcgatctcgtcggtggcggccacatcggccggtgcgttcgcgatcgagaacgcgcggctctgcccgagcccggggatttcgagctgcacgtactggccggcctggaaatggatcggctgcgacagcttcaggcggatcgacttgatggtcggcgtgagctgctcgatgcgcgtgacgtcggccgcgaagtccttgaccgggatgatctccgcgtcgggctcctcgtcgacgtcggcctcgatcacggtgtcggcctgcagcgtcgcgcagcatgcgagcgccttgccttcctcgcgttcgaaatccatcagcgcgaacgggttcgcgtcgccaagatcggtctcgccgtcgagcacggcgaccttgcaggtgccgcacaggccgtgacagcacgcgtgcggaatgtagatgccctggcgcagcgcggcatcgagcatcgtctgtccttcctcgacctcgatcgtgacgcccagcggctcgatggtaagttggtggctcatgatggttcgctcgtccgcgtggcggtcagaagctcgcgccgccgaggccgtcgaggcccggcgtgcggaagctgatcaggtccttgtgcccgaggccgttgccggcgaggctctgcgcgggatccggcgtccacggctcaccggagcggaaccactcgacgcgatcccagtcgatcttcgcgaaatccgggtggtagccgtagacgggcggcagcacgtcgcgcgcgagcgcgccgaacggcaggtcgggcggcagcggcaggcagaacggcgccgggaacatcaggtggtcttcccagcacacgtagagcagcggcgccgggaacttcccgaccgcgtccttcaccgggaagtcgtagggtttgagcgcgatgacggccatgtttgtctcctgtcggccggcgttcgcgccttcgcgcgtgcgccggtctcgttcaaggttgcgtattgatcagttgctcgtgacctggccgcgccaggccgcgaagttcttctggtcttccgagccttcgaaatcgaggttgtcgcggcccatctgcaccgcgtagtagtcgagcaccgcggcaagcggatcgaagccttccgccgtcgggtccgcatcgggcgggaagcagttgccctgatggatctggtgcaccggcagccacgcctgcacgtacttctgcggctcgtgatcgaagatttccttgcagtgatcgctgcagaaatggaacttgttgccgaggtaatccgattcgcgcgcgccgatcttgcgtgcgttgccgggctcggtgaacagcatcgggatctggcaggtctggcacagcatcggcagcgtcttcatgtagaagcggttgccggccttcgcctgctcgccccagtaatcgaagcgcgggcggtagtagcggtcgaacgaatccggatatttcgcggacagccacgccatctcgtcctcgcccggcacccacgtatggaatgcggacgccgcgttgaagccgtagaacgtcgaccatgcctggtggctaatgtggtccttgccttcgcatgcgtcctgccagcccttcggctcgcgaatgccgtagcgcgcgagatccttgaacagcgcgccgccgttctgctccgcgtacatctcccacgattcgcgccagctcatcacgcgcttcggctgcatgtagtccatcatcatcgcgacgagcgtcagcagccggtagccgcgccagaaccacttgtcgatccagcgctgcacgatcggcacgttgtcggggtcctgttcgagcaggaacttgatgcactcgatgccgagcgtcatgtgacgcgattcgtccgattgcgcggagaagccgaacgtgacggtcgacatgtcgccgttgtacgcggcgcccgacatgaacggcacgaacagcaggttcgtcagcacgtattcgaacgagaagctcacggcggtcaggaattcgaacggccccgacgaatacgcatcctcgaagaacgacttcggcaccgacaggtaccagacgcgatcgaaccagtggttcgagtgatggaacccgttgaagaacctgttgtacgtcgacatcgcgtgcgtttcggtctggtagtgccgcagctcgtcgatcgactgcatctggcacgcgatgcgcgcgccctcgccggtgaaatgccggccgacgtgcgcgaagccgcggtgcgcgaggtattcgagcggcgtcacgccctggatgaacagcttcagcgcattgatgtagcgcgcgtccgtcacgccgaggaacgcgttgttctgcgtgaacgcgtcgatcaccgcgtacagtttcttttccttctcgccctggtatttccagtacgcgtccatcgtcaggcggaacgggtcgacccacttgtcccagtcgtggatcttgatgccctcgtagcggtcgtacgggaataccttgtccatcggctggtaggtcgtttcccagccgaggccgcgcgtcatcgccgcgtagcggtccttcaggccgagctttttcttgagcgtaggcgtatccattcgtgtctccggtgttgtcggtgcgcggtgcgcggcgttcagtgcgaccagctcagcgtgaactggtcgtcgtcctcgtcgatgtggcccgacagcgtgatcaggttcacctgcagctgttgcaggtcgaagcgcgtgccggtcagttcctcgatcgtttcgcggcggatcgtcaggcggtccggcgaatcgatcttgaccatgccgggcgactcgaccaccgtcgcgagcgggttgtccgcgacgatcgcctcgacgatcggtctggaatcctcattggcctggaaggcgatgaatacgttggacatgctggtttccctgtttgagtgattgacgcccgtcgtcagaacgcgatgccgagcttcgcgatgcgcgcatggaacagctcgcgcacttcgtcgagcgccgcacgaccgtcgtcccgcaacgccagcgccgccaccggcgcgagcgccgcatcggcccgtgcgggccagtcgcgcgtccagcgggcaagcagtgcgcggttgtcgtccgattcggccgccatcgttttcacgaccgcgtcgatccagcggttcgattccgtgtgccattcgggcatgaacgcggtcagcatcgcgacggccgagccgcccgcgagcgcgatccgttcatcgacgaagcggtcgtatatgagcggataaagcagcccgtcgagcgcgaggttctgcgcgacgaacagttcgaccggatcggcgacgaccagcgtgtcctcgacgtagcggcgcagcggctgccacgcggcgccggtcagccatgccgccttggccgtatcgagcgtgtcgggctcggccatcgcaagcgcgagacgcgtgaggtactgcgcgacgccgaggttgtccatcgcatggaacatcgcgggggcggtgaacgccgtgccgtagccgagcgcgcagacctgcgcgttgttcatgttcgcgccccacgccgcgtggcgcagcggcaccagcacgtcgagcgcgtgcgcagcgacgtcgtcgcgcatcaggccgatcatccggcgcgattcgacgaactcgaagttcgcttccatcgtgtcctgctggcgcgcccgcgcggttgcccacgacgcgtagtagaactggcgcgggtccttcagcgcataccagtccgccatccggatcgccgagcgcgacgcgtcgaagatctcgtgatcggggtcccacgtcggccggtaatggaagttcgcctggggctgcgcgcccatcatgccttcctggtagcgcgtcgccgtcctgtcgccgccgatgtgctgcgcgacgtgcgcaaaggtgtgccggagcggcttgatgtcgactgtcttcagctcgatggtcacttcttgctcctcaaggtcatgggttcgcttcgaggtccagccgcgtgacctgctgttcgcggcagaacgcgtcgaaggcggcaggaggcaacgtcagctcgacgcacagctccggcgcgccgccgatcgacagctcgaattcgacgaagccgcgtgagttcgtgccggtcacgcggacgcacttgcggcccgggtcgagcggagaaagatcggtgtcgggtggattcatgttcggtgtcgcctccatgccgtccttcaatgcagcatccgtgccacactcggccggcccggcaaaaatctcgataattcagggaaagccctgacgtaaagtttgaattcgagatccacaatggcggttaaccagaacgcgatccgcgcccggactatcgcgccgaacccctgatcagacggactccttcatcatttgatcaatccggtttcgcgcatttgatcaaatgatcaacccgtcacgtgtcccggggcgcagcttgcggaaatttcgaaaatcacgagaaatctcgacggaggagacatgacgcggcccagcctgcccccttgccgccagacaccgacctgcgcaagctgatccattttcggcgagcgacggccgcatctggctcgccggacagcggatggtgctgctccatgccggcgcgctggcgacgctgcgccaggaactgatggaaagcgtcggcccggcgcagacgcggcgattcttcacgcgcgtcggctttgccgccggcgaacgggacgccgcgctcgcgcgcgagatccgcagcggcgcatcgctgttcgacatgtttcatgtcggcccgcagttgcacatgctcgaaggcgcggtgcaggtcacgccgctgcgtttcgaagcggaccctgcgaccggtgcgttctattgcgagtaccggtgggagcattcctgggaagccgacgtgcaccgccgcacgttcggcccgcagcccgagcccgtgtgctggatgctgatcggctatgcgaccggctatacgagcgcgttcatcggccggaccatcctgttcaaggaaacgtcctgtgtcggcatgcacgatccgcactgcacgatcgtcggcaagccggccgacgaatggcccgatgcagaggaaatctcgtcgtggttcaaggccgattcgctgatcaatacgatccgcgacctgcagaccgaggtcgaatcgctgcgcctcgaaatcgcgcccgacgacagccggacgaagctcgtcgggcgctccgatgcgtttcgcgccgcatacgcgctgctcgaaacggccgcgccgaccaaggtcgccgtgctgctcaccggcgagacgggcgtcggcaaggaacggttcgcccgcgcgctgcacagcctcagcccgcgcgccgcgaagccgttcgtcgcgatcaactgcgcggcgattccgcacgcactgatcgaatcggaactgttcggcgcggagaagggtgcgtttacgggctcgcaggccacgcgcgccgggcgcttcgagcgcgcgaacggcggcacgctgttcctcgacgagatcggcgaactgccgctcgacgtgcaggccaagctgctgcgcgtgcttcaggagggcgaagtcgagcggctcggcgcgacggaaggcaggaaggtcgacgtgcgcgtcgtcgcggcgaccaaccgcgacctcgaacaggccgtgcgcgacggcacctttcgcgcggacctctattaccggatcaacgtctacccggtgctgatcccgccgctgcgcgaccggcaggacgatatcgcgctgctcgccgacgcgatgctcgaacgcttcgcgtcgctgcacggcaagccggcgcccacgctgaccgactatgcgtacgacacgctgcgcggctaccggtggcccggcaacgtgcgcgagctcgagaacctgatcgagcgcgcggtgatcctgtcgcgcccgaaccggccggtcgacgcgaaggacctgttccccggcgtcgggctgcccggcggcgcgacggtcgaccgtgcggggcagattcgcccggcggccgcgctgtcgatcgactgcgcgacgctgctcgaccagttgcagggcggcggcgggctcgacggcctcgagcgcgcgctgctgcatgaagccgtcgaccgcgcgaacggcaacctgtcggccgccgcacgcctgctcggcgtgacacgcgcgcagctcagctaccgcctcaatcgcaaacacgatcaggaggacgcctgacatgaacaccatcctgcccgcgcccccgttcaccgacacgctgcccgacgacgcgtcggcgaccgacgataccgtcgagccgcatgcccgcacgctcagcgagcatgcataccatcagctgcgccagcacatcgtcgaaggccactacccgccgggcgcgaagctgcgcgtcgagcatctgaagaacgtgtacggcgtcggcgccggcacgctgcgcgaagcgctcacgcggctcgtcagcgatgcgctggtcgtcgccgaagggcagcgcggctttcgcgtgacgccgatgtcggtcgacgatctcgaagcgatcacacggctgcgcatccacatcgaggtcgatgcattgcgcgaatccgtgcgacgcggcgacgacgcatgggaacagcgcgtgcgccagagcttcgagatgctgtcggcgtgggaacaaccggtgtcgatcgcgcaccggaccgcgtgggaagcctgcaaccggcgctttcacgaagcgctgatctcggccgccgcgacgccgtggacctacctgatcctgcggatgctctcgcagcaaagcgaacggtaccggcgcgtgtgcattgggctcggcgattcgaagcgcgacgtgcatgcggaacatgcgtgcctgttcgacgccgcgatgcggcgcgccgatgcgcgcgcggcgctcgcgctcgaggaccatatcggcacgacgcttgcagtggtgcgcaacgcgccgcccggcacgctgccgttctagcgcttcacggcatgctcgaggcgctcaggccagttcgggataaccgtgcgcggccgcgtcctgcgcgaaccgtgcaatcgtgtcgtagtcggccggcagcagccgttcgaagcccttcagccgcagcacgcgcgcccgttgcgcgtcggcggccgccgcgcgatcgagcgcgtcctgcaacgcgccgacctgtgtttccggcagcgcgcgcgacgcgatgaacggcaatcccggcgcggaagccgtcgtaccgatgacccggatgtccttcagcagatcgggcaacgcgtcgcggatataagcaaacgtcacgcagtcaatcgccccgcaatcggcatcgcccgacgccagcgcacgcagcacgttcacgtgcgagccaacccgcgtgaccgacccgaagaaatgcccgtcatgcgcatgcggcgcgaccgcgtgcctgaatgcgttcatcccgctgtgtgaatcgtcgccgttgagtgcggcgcgcagcccgcgacaggcggcgagcgtcgtcgtgccgcccgcgtgcacgcgcgccgacacgaccagcacgctgctatagcgcgccccgtcgcagccgtccgcgtcgaaagcgggcgtcgcgatcaaacgcacgacgccgcgcaacccgagcatccggtacgggtagccgcaggtctgcgacagcagcagatcgtcgcgccgccacagcgcatgcaggtcgtcgaacggcgcatcgggcagcgctacgccggcagggccgcccgccttcgcgaacgcgtcgagcgcatcgcgcaacaacgcgcgccacagggcggcgtggcgcggcgtcacgttgtacatcggcagcactgcgatccatgggttcatgcgggcattctacgcaccggcggcggtcccgatgcttatcggcctcgtcgcgataagcaaatgcgaatcgattggttggcgcggcagcgctgccccggtaccgttcgaaggcctgccggcgctgccaccttgcgcaatgccggacaggccgaccgtgatccgcgagacacctgcgcaccgggccgagcgcaccggttccatcgctcgttccccgcactgcccgatccatccgcctcaacgccatggccgaatacttcgacgtcgatcacgcgcgcgcgattgccgcgctcggcgcccgcttcaccgcccgcaccgagtggccgacctggcttctggtcgccgtcatctacggcggctggctggccgtgctgctgctcgtgcgcgacgggcacctgtcgctcgcggccgcgacgccgtcgctgatcctgctcggcgcatggcacatgtcgctgcagcacgaactgctgcacggccatccgacgcgttccgcgttcgtgaacaagctgctcggctatccgccgctgacggtctggtatccgtacacgctgtatcgcgacacgcatctggaccatcatcgtgacgaagacctgaccgtgccgggcgtcgatcccgaaacgaactacgtaacgcgcgaacgctgggcgcggctgccgcgctggcgtcgcgcgctgacggtcgcgcgcaagactttcatcggacgaatcgtcgtggggccgccgctcgccatcgccgcgacggtcgccgatgcggtcgccaggttccggcgcggcgacttccgccatctgccgatgtggatcatgcacgtagcctgcgtggtcgtgctgctcgcatggctgcaacgcgagatcggcgtgccgtggtggtactacctgctggccgtcacgtggcccgcgctgtcgctcgcgatgatccgctcgctgtacgagcaccgcgccgcgcggcacccgaaggcgcgcatcacgatcaacgaggccggcttcgcgatgcggctgctgtacctgaacaacaactaccacctcgttcatcacgacctgccaaagctcccgtggtacgacctgccgcgcgcgtaccggatgcggcgcgacgcgtatgcgaggaaatgcggcggtttcgtgatccgcggcgggtatcgcgagctgctcgcgcgccatgcgtggacgccgaccgatacgcccgtgcatccgttcgaccagggcacggcgtcgctgtcgacggggagcggggtaaaggtggcggtggtcgacaaggtgctgcagatcagtacgtgacgtgcggcggagccgcactgcttcgtgaagcagcccgattcaacgacgcgggcgtcaggccgtacggccagcgattcgtccgccgcgccgcatttttcttacgaaatgccgacgataccgctcgtgcccgcgcattgccaattgcgccgccaatgtccagaatggcggctcgtccggggcttccaacaatcattcgccccggctctgcccccggccacgcgccgcacgccccacgacgatgcaatcgaacaccccgcccggcgcaatccgcgcgatcggcaacgactggtccgtttccgcgatcaccgcgggctttctcgcagtcctgatttcctacgcgggcccgctcgcgatcttcttccaggcgtcgcaggccgcgcacgtgtccaatgaaatggtgtcgtcgtgggtctgggcgatctcgatcggcgcgggcgtatcgggcctgttcgcgagctggaagctgaaggtgcccgtcgtcaccgcgtggtcggcacccggcaccgcgctgctcgtcggcctgtttccgcaactgacgctcaaccaggccgtcggcgcctacatcacggccgcgctgatcatcctgctgatcggcgtaaccggctatttcgaccggctcgtgcgtcacattccgcgcggcatcgcgtgcgggatgatggccggcatcctgctgccgttcggcacgcacgcgttcgccgccgcatcggagcagcccgcgctcgcgttcgggatgatcgcggcctacgtgatcttcaagcgcctgctgccgcgctacagcatcgtgctcgtgctgctgacgggcgccgcgctcgcgacggcgctcgggatgacgcatctcggcaacgtgtcgccgagcatcgcgcacccgatcttcatcgcgcccgaatggacgctcggcacgacgctcagcctcgcgctgccgctcgtcgtcgtcagcctcaccggccagttcctgccgggcatgacgatcctgcgcgtgtccggctatcacacgcccgcgcgcccgatcatcacggcgaccagcgtgatgtcgctcgtggtcgcgtgcttcggcgggatcacgatcgtcgtcgcggcgatcaccgcggcgctgtgcaccggcaaggacgcgcacgaggatgcgggccggcgctacgtcgccgggctcgcgaacggtgcgttctacctggtcggcgggctcttcgcgggcacgatcgtcacggtgttcttcgcgctgccgaaggcgttcgtcgcgatcctcgcggggcttgcgctgatcggcgcgatcggcgcgaacgtgcacgggatcttcgaggacgagaatcaccgcgaggcatcggtgatcacgttcctcgcgaccgcgtcgggcatgacgtggctcgggctcggttccgcgttctggggatcgtgatcgggtcgttttcgtatgcggtactgaacaaggtgcggcgacaggcgtgatgcgcaacacgcgcaacgcccgccgccgcgtcgatcagcgcgcgtgctggcgcaacagctgcgcgagtgcatcggccggcgccgtcgtgccgtaaagccgctccgatacgccctcctcgacgtcgatctgtccggcgttgtgcacgtcgtagagatcgacgatcaactgtgcatggcgttcgctgaggcccgcgcgcagcagcgtcgcggcccaggtgtcgcgcggcagttcatgcgcgacgatcgaccggcccgccgccgcgccgagcgtatcggcgatcgccgccacgctcacccgctgcggcccttcgacgctgacgatgcgcggcccgttgccgccctcgggcgcatcgagcagcaaccgcgccgcgacggcgcccacatcgggcgcccagaccgtcgggaacaccttgccgaccggatggtgaaagctcggcagcacgccggtgccgagcgcgaccggcagcacgcgcgcccagttctgcagatgctcggccgaacgtagcagcgtcaattgcgtcgggatcgttctcagccgttcctcgaggtaatggaacagacgcgtgatgcccgtgttgccttcgcgctccgcgccgtaatccgacagggcgagtagcgcaggcggcgggtttgcggcgagtgcggcggtggcgacgtcgatcgtccgcgccatcgtcgcggccggatcggggtcggcgacgggtaccgggcacagtatctgtacggcccgtgcgccgtcgatcgcggatgcgaccgcgttcacgtccgtcagctcggcgatcacgacatcgcagccaagctgcgcgaagcgttcacgatggcgtgcgtcgcgcaacaccgcgcgcacgggatggccggcgttgcgcaaggtcgtcacggtcgactggccgacgttgcctgatgctccgaagatcacgaacacggttcgctcctggggatgaaggtggggtgattgtcgggtcggagagccagggtgtcggacacaaacggatgaatcggacagaaatggacgaacgattcaatgtctgacggttcccggctggatttcagtggagctcgaaggcgaccgaggcctacctgaccgatatcaagccggtgtttgccggcagttcataccgcaccaaagagtcccgcatccgaaagtacctggctcccaggctggacggcctgtgcatggacgagattggccccagtctgattcgtcccattctggagggatgcaaggcacacggggcctgggcaggcattcatgtgaaaggcaacttgtcggtcctcttcgagttcgccgtgattcgtggcctggctgaaggcaatccgattcctggattgcgtgggttgctgcgcgcgcccgtcagccaaagcaggccgtcacgactcgtgtgcaaattccaggccttctatcaaaaagctgcagagctatctgcggctatccggaaacatgcctgagcctgaagctcatcaccctgacggcttgccgacctggccaagcggccgatgctgaatgggatgagtcgatttcgtggatagccaccgccgggcacctacgccagccccgcatcgcgggtgctgccgtaggaccatgctacgcgcggcgtgctggagcgatagctgtcgtggtagccggccgtgttcgtgaacatgcgtgagccgatccaggtcacgtcgtgcatctgcacctcgtcaagctggagacgctgtatgaacagcttgaaccgaggcggtgcgggtgggcgagcaggaataggaattggttgggtgcctattgttggacgagggcgcgccttgctccatatgtggaaccgactaccttgctggggcagacagtaatcccgtgccgcgacggtcgccacgaagccatatccagcggtttgcataccaaattgaatttcgtacaagttgcctgatttccgcgtgaattttcagaatcgtctcatatccccaccatcaatcaatgcccatgctggcgtccagagaagtccatgtacgtccatctctgctgagagcctgctgcccaccctgccctagcggcagcagccgtaggtgctcagccacttggagcatcgatggcaagacaatccgatatgcgcttcaccttcaaggcgggggcctcgagttcgatgtggtttcgttcgagctggaagaaggactgagccagccgttcacgctgtcggtcgacctggccagcaccgatccgtcgatcgacttcgcggccgtcctcgaccagcccgcgcagctcaccatctggcgcgccgaccagcccgtgcgctacgtccacggcctggtcagcgatttcgaacaaggggacaccggctttcgccgcacccgctaccgcgccgtggtcgagcccaagcttgcgcgcaccggcctgtgcgccgactggcgcatcttccagcggcagagcgtgccggacatcctgtcggcggtgctcaaggaacacgagatcaccgactacgaacagttggtgaccgagacgcatctgccgcgcgagtactgtgtgcaggcgggcgacagcgacttgcatttcctcgcccggctggcggcggaagaaggcttctactacgcttttgcctttgccgatgacagccaccgcctggtccatggagacaatctctacatcttcggctccatcgacggcagcccggtcgaatacaacgccacgccgggcggcgaccagcccacgccggcgctgcggcgcttgcgctacagcgagcgcgtgcgcaccgcgcggcagacccagcgcgactacaccttcaagcacccgacctataaccaggagcatcaacacgacggcgcgcagctcgatcaccagagccaggactacgaggtctaccaattccccggccgctacaaggaagacgcggcggggcggcccttcacccggacccgcctgctcgggctgcgcggcgacgcccgcaccgccgaagtggaaggcgacgatgcgcgcctggtgcccggcctggccttcgacctcaccggccatccgcgcgccgacctcaaccgtggctggcggcccctgcgcatcaggcatcgcggcgtacagcacaccagccaggccgaggaaagcgcagacgcggaactgggcacccactacagctacaccgccgagctgattcccgacgatgtggaatggcgcccgcagccgatggccaagccgcgcatcgacggcccgcaggtcgccatcgtcgtcgggccgccgggtgaggaaatccactgcgacgagtggggcagggtcaaggtccagttcacctgggaccggcagggcaagtccgacgagcacagctcctgctggatccgtgtttcgcagaactgggccggcgccacctggggccacatggccatcccgcgtatcggccaggaagtcctggtgggcaatatcgacggcgattgcgaccagcctctgatcatcggcagaacgtacatggcgctgcagcggccgccgtatgagctgcccaagcacaacatcctcagcaccatcaagagcaaggagcacaaggccggacgcaacaacgaactgctgttcgacgacaccaatggcgagatcagcaccacgctgcgcagcgaccagggtgccagtgcgctcaacctgggctacctggtctacccgcgcccgggcggcggcaaggcgcgcggcaagggcttcgagctgcgcaccgacgagcacggcgcggtgcgtgccggctccggcctgctgctgaccaccgagccgcgcccgcatgccagcgagcatcacaaggacctcaaggagaccgccgcccgcctggacgtggccggcgagcagcaggagggcttcggcacccaggcccgtgaagttcaggcgcaggaggcgggtgaccaggatatggtcgccaaggcgctgaaaaagcagcaccagggcatcgtcggcaacggccccggcgatccggcgagcaacaactttcccgaattcgcgcagccgtacgtcgtcgtcgccagcccggtgggtatcgccaccagcacgccgggctcgacccatatcgccagcggcgagcacattgcgctcagcagtacggagcacatcagcctgaccagcggcaagcgcctgctcgccagtgccagccgtggcatccgcctgttcgtgcagagcatgggctatcgcctggtagccgcggcgggagacatcgacatccgcgcgctgaaggacagcatcaacctgctggccaagctcaacatcacgcacaccgccgagcgcatcacgctgaacgccaagaccgagctggtcatcaacggcggcggcagcgccacggtgtacaacgccggcggcatcacccaccagaccagcgggcgctacacgggccatgcggccaagttcagctacaccggtccgagaaaccgcgcggctagtttcccggagccgcccaaacccagccagggcaatctcgagctcttcaatcgttacgccaaccagcgtggcctggcgaacggcggtttcgaggtcaaggacgcgctcggcaaagtcttcaagggcacgctcgattcagcggggcgcaacgtcgtctccggcgtagcaccagggccggcaaagattcgttttgggctggacccggctaacccttgggaggaagccagctatgtcggcgtgcccaagtggcctgcgaatccgcccagtggcagcgccagccaggtccagtcccttgtcgctggcgccatgccgtcacaggccatgggcgccgcgccggtgccagccatggcgaagtccctgagtgctggcgccacgccggtgccggcatcgggccccggccgctgggtcaccacggacaacgattaccacggcatcaaaaacaccggggtcatgttcatcaatcgcctgacctccatgggcgacgaagggcgcctgttcggctccgacggcaaggactacatgaacaccacgcgcgacaagatccagcagtggaagccgctcctgcggatgccgatccgtggctcaaggacaactctgctgtccatgtctacggcgagacccggaagatcaagcaacgctatctcgaaggcgccgatgcctgggccatcggcggcaagtcctggcattggcaacccggcgttgccgacgaagttcacgaaatctagggggcaaaccatgaaagaaacacgcctgctgctcgaaaacacccacgccaacggcgcggcggtcagccatggaggttacgaggttgaagatgcccggggcgagtcttcaccggcacgctggacgaagccggccgcgcccttgtcgttgacctggctcccggccccgcgcgcgtacagtctggcggcgacccggccgccccctgggacaagagcagctatatcggcacgccgacgtggcccccacgccggttcagcggacagcggccaatccggattcaaaccgggaggtgccgtggtgacgcgtccgctctacctgttctggggcgggctggatctgctctatctgattcgcttcctctggctcaacctcgccaacggacgcattccgctgtaccacgacattcaggcgttcgggcaattgcacgagccgggcggctatgcggccgtctggttcggcctgtccctgctgctcaccgtgtccatcgccgtgtcggcctgtctgtttctggggaagccgctacgcgcggccgctggcctatgcgcaggtaccgctgcgcctgctcttggcggtgccctctctgtcattcatcccatggctattgcacctgggcgaggggtcgagtctgccgctcaacctcgggctgctgttgctatccgagttgctgaaggtcgtcaccctgcgtcggcacgggcgcgcgaaaggtcctgccgcccccgctgcatagcgctccgcccaataccggcccattcatcaccgagcacggccgtggtcatgccgtgcaagccaacctacaccacgagtcacgcatggcaagcccgaacccgcaggaacaacaacgtgaaccccaggtggccgtcgcgccgctgaacaccgtcgatgcccgcgacgtcaaccgcggcgcccaagagttcgaccagtggctgcgcaaagtcagcgatggcgtggtcaccctcgaccgcatccgtaccgtggcggggtcgctgcccgtggtcggcaacatcatcgccctggtcgacagcctgggcgatatcgtcaccctgtcgcaggccaaggagcgccaactgctcgattgggtcagcctgggcatcaacctcatcggcgtgctgccggcgccgccgaccatggcggcagcgcgcatgagcctgcgcccgaccctgttcctggtgcgccaggagctgaagctgaatggcaaatcgctgctcggtgatgccctcgtcaacgtgctcgtggcccacctcaacgccagcatcgtgggcgagatcgacaagttcgccaaggaagcccagggcaagctcaatggcatcctcaaggacgcgggcgaatggggcgagaaggcgatcgtcgacatcgcaggcggtctcgaagcgcttgccaagggcaaactcaacgcctccggcgacgccaaggcagcggccgagcaaatgcgtgccgctggcgaccagttgctgcatgatcccaaggccagcatcagcaactttctcggcgccttgtgggggcctataaagccaccggcaaggccgccgccaacgttgccgccaaggccctgctcgacgagcgccaacgcgaactggtgctccgcaataccgaggcgctgcgcaacttcgcgccggaactcaagcgccaggtctccagcctgggcgacgagaaagtggccaacagcatcggctatctgctcgcttccctggtcaccgccttggcgcggtggcgcgcgcgagctgccggccagagcgccaacgtcaagcccaagaccacgagcaagggagagaaaacgggctcggaaggcatgatcgaagcccatgcaaggcagcaccccaccacgaacgaccccaatccgctgaaggacggctgtgcctgcgccaagaccaacggcagcatcagcttcgccatgggcagcgagacgctcagccacacagatttcacgctcccgggccgttccccatcgactggacgcgcacctaccgctccagcctgggggcctacgatgcgggagatcttggtgcgcgctggatcaccccgtacaccacgcgcttcgatgtggttggcgacggggtgcgttaccacggcgccgatggccgcagccacgactacccgctgcccaaggtgggcgaagcgcacgacgaccgcatcgaagacctcacgctgatccgggtcggcgaaagcaggctggcattgtgccgagggttcgagcgccgcgagacctaccagcgttatggcgaccgctacctgctcacgcagatcgagttgcgcggcggcgccggcatgctgctgggctacgaccatcgcataggcgagcgcgtggtgctctccgacatcgtcacctaccaggacgaccccagccagccgcacacccacctcggcaccgacgtggacgaggccggccgcatcatcggcctgtggctgatgggcaaggaaacgccccagcgccgcctgagcctgtatcgctacgacgaggccggcgacctcacgctggcccaggacgagaacgccgaggtctggacctacgcctaccagcaccacctcgtcacccgctacaccgaccgtaccggccggggcatgaacctcgcatggcagggcgaaggccccgatgcgcgcgccgtgcatgaatgggctgacgacggcagcttcgaggtacgtctggagtgggactcgaacattcgcctcacctacgtcaccgacgcgcacgggcaggaaacctggtactactgcgacatcctcggctacacctaccgcatcatccacccggacaaacgctccgaatggttcttccgcgacgatgccaagaacgtcatccgccatgtccacaccgatggtagcgaagaccgttacgcctacgacgagaacggcaacctgctcgaacacatccgggccgatggcacggtggtgcactacgcgtgggatacgaagaaccagctcatcaagatcagcgatgccgagggtgggctctggctgcgcgactacgacacgcgtggccgcctgaccgagagcgttgacccgctcggcaacaagaccgagtacgcctacaacccgatgggcctgccgatcggcatcaccgacgccagcggcaagatcaagcagctcgagtacaacgtcaatgggcagctcacgcgctacgtcgactgctccgccaaggccagccaatgggcctacgacgagcgcggccagctcgtgcagttcaccgacgcggtgggcaacgtcacccgctatcgccacgaggccggccagctcgccgccgttcgccacgccgacgacagcgaagagcactttgagcgcgatgcggaagggcgcctgctgacctacatcgatgcactggggcggcgtaccgaatgggactacaccgaggccgggctgctcgccagccgggtggatgccgcaggccagaccctgcgctaccagtgggacaagctcggtcagctcaccgcgctgcgcaacgagaacggccgcgacgccgagttccactacgatccggtgggtcgcctgctcgccgaaaccggctttgatggcgccaccacgcgctacgagtacgaggaagaaaccggcaagctggcgcgagccattgacggccagcgcgtcaccgcctataccttcgacgccatgggccgtcttgcagaacgccgcgcggcgctgcaaaccggcgagacgccgccgcgtgagcaggactggcaggtggaacgcttcgcgtatgacctcaacggcaacctggcgctggcgaccaacgccgacagccgactgcaatggttccacgacgcggccggcaacctggtgcgtgagcaccagcactacacccgcctcggcaagccgctggtcggcgtatggcagcacgaatacgacgcgctcaaccagcgcatcgccaccgtgcgcccggacgggcacagggtgagctggctcacctacggcagcggccacctgctggccctgcaactggacgagcgcgaactggtcagctacgagcgcgacgacctgcaccgagaagtcctccgcacccagggcaactgcctgctgcaaacccagcagtgggatgcgcttggccgtctcagcgaacaggtgctggtccgcgaggccaagggcccggccacgcagaccggtggcggcagtcgcctgctggtgcgccgctaccgctacgacgccagcggccagctcaccgacatcaacgacacgcggcgcggccaactggcctaccgctacgatccggtgggccggctgctggaggcacaaagccgcctgggccacgaaaccttcgcgttcgaccctgccagcaacctgatcgatccggccgaacagcgcgaggccgagcgccagcgcatgccgcgcatcaaggcgctggacaacctgctcaagcaatacgccggcacccactaccagtacgacgcgcggggcaacctcagcaagcgctggcaccagggcaaggagagccgctacacctgggacctgttcgaccggctcacacactacgaggatgagcgccttgcggtcgattacacctacgacgctctcggccggcgcctgtcgaagtacagcaaggcccactacgaggaacgtcgcgaggccggcccgcactggaaccgcgccgagcgggtgaagcgtaaccgcgaactgcaatgcggctttacgctgtacggctgggacggcgatacgctggcgtgggaaagcaagattgccgacgaggatggcttcggtgcgcgcaccacgcactacgtgtacgagccgggcagcttcgtgccggtggcgcaggcggtacgcgacgacgccattgaactgctcgaccagccggactacggcgactactaccggcaggacgaagacccgctgtggatgccaccaccgcccgcgccaccgatagacggcttagcctggtatcagtgcgatcacttgggcacgccgcaggaactgacggacgagcagagcgagatcgcgtgggcggcggagtatcgcgcctggggtgtcgcgcaggaggcgattcgcaaggcctccgatggacgcgtggaagtgcgcaatccgatccggttccaggggcagtaccatgatcacgagacggggctgcactataaccggaatcggtactatgacccatactccggtcggttcgtcagtaaggacccgatcgggctcgccggtgggatcaacgtctatcaatacgcacccaatccaacggggtgggttgatccgcttgggttatccggttttgaacctaaggttctaactagcggaacagtctttagaaatgcatcggggacccccgatagcttgactccgcgcttaggaaaagacacgacccgaatcgatgggaaagagccgggcttgtcggcagccacttcggaagcgggattggacagcgggaaatatgttgagctggacatcggcaagctttgttcgtgcgggcttcaagcgacgcatgataagccgaatggtcacgtgaccattcgaccgataaacgatccgaccgattccaaattaacagactgggcgaagtccagggaggcagctcgacgcattctctgacagaaggtatattgggagcagtcactggtcggggaaaagtgatggcgaccgatatccaatcctatttgtcagaatatgtagcaaaggtaaaatgtgccattgaaaagagggttaatattgagtcatcgaattcaggattttaccaaaactctctcggcggtacggcatacgtaagcttctacccaaaggagatcgatctaacacttgatctgacaggtgcgggtgataaatacagggtaactgccgatctgacggatcaagaggaaaagtgatttctggagatatctttaaattcgatggggatccagagtatttgtgcatggcgcttgacgcgttcttccctgatttggttaagttggtttcggatttcctttaaatgaatgagatggccgcgtcagcggcccctggttcgtctacagccggcatcggtactatgtccaggcacgggagactcatcagcatggacccgatcgggctggcgaaagggttgaacgcgttccagtacgcgccgaacccggccgggtggattgatccgctgggcttggctaagacaacatgcgacttatatgcatttggtaatgccagtggtccgcgcgaacctagaattcaaggcgttaacacaaaatcgggacaaaacgcagacttgattgccgacgcagttggaatggtggggccgactactgaaggaggagcgtcgacattcggtgatatcaataaggcacctatcacaagcttccagctggatcggaactcccagacgggatagaggtcgttgcggatggcaaggacgttggcgggtcgcatgccgcaactcatcatacagtttgtccgtctaagcgaatgtcgggacagacatttgtcgagaaattcaaaaatatgccttgaattaaggcccggaagaattaatcatgaaagatgaagaaaatgactcgtggaaaaatcttaaagaggcttatcggatctacgtgaaattgagggatgggtttgtaaaaaaacatctgccgtttcttttattcagagagccttttccgtgcctgaggaaagggctatggctatcgatttggtgttgagttaccctgagtcagagagggttgatttttaaacagttgatctcaatgtcaagctatgtaaatggcttcacggaagagtgcagaaatttgatattagaattgccgcgtgattgggtgaggaaaaatatcgaggcagaagttgatggggtgctggttaatggggttatgaagagtatcgctgtttgctagagttgtgttgtgatctggatcgagggttgatgattaaatttgcgaaacgtgctctggatagttctgacgaagacatcaaggatgcaggtgcagattttctgtcccgctaatctgatcgaggtcgggcagttcagatgggcaacgatatcgctttaatgcggcgtggcaactgtcgcgaatcgaagatagccgcgcgggtggaatctactatccggtcgattggctgatcgaggccgagatccgtgccgggaaatgaggcaatgagtgccagttcacatgaaccgacggcgatacggctatgacgtgctatccgatctactctatccaactgtcatgtgatgtcgagatgccttgctacacaaggctcaacgacatgtcatttatcgcacgataccactatgacgatgaatgcgaggtgcatcgctgcaagagattgcgaaagctgaaaggtcggtcgtagcggcaagtagacggggctgcactacaaccggtatcggtactacgatgcgagtagcggacggttcgtgagaaaggatccgatcgggttggcaggtgggattaatatttaccagtacgcgccgaatccgatcagttggatcaacccgttcgggctgtccgctgcatctgatttgcaacggatgaaagggcgaagcgtgccgcgcgttaggtcagtgctgaatgatgcgggcttcgccaaaacgaaagacaacggcgtaaacgagacttggaagcatgcggatggatcggaggtccgagttcacaaatacggaaacaagtgtccttgcccttatagatcgggaaataacgcgcatgtccacaaagaagatcctgctgggaatcaacttaatgatcgaggacttgtgtcaatagattcgaatgaaacacacattggtaaccgtaatcctgctgatctaccagctgttcgagggaggccgcacggatcatgagctacgaatatagattggtgtttgacgacactacttcagcgcagcatgtcatggactcgttgaagtcgagtgacgcatgcgtcaaggcgcaggcactggaagtttgtctgaaggatcgggagctacagacattggccgaatatgatgctaggttgactcaagagagcgatcgatcgctatggctggaagttaattttagatcgctgaatttatgcaatctggtgcaaggagcgttgagcggcagggttgttagatgtttcgaagatggggactgggacgatgaagtaacgctgaaggaagcgtttcgagtcaagaaaacaaatagacaactagggccgcgaacgaggtcctcgttgttggtgtgatgagttgaagcttggcgttcaggtagaaattatcggtgaaggttatcgcaaacggggcgattcagttttgaatacgtccgatgttactgcatttcgccgatatggaaatatcgccactgcattctcgcaattgtcgaattatgaagaaaattatgaattttaactacattagatttcttcattatttcatttattcgatgagcgacgaggatttggatgatttttatataaataaaaatcatatttttagaaattagtcactcgccacgcgataccgctacgacgacgaacgcgacgtgcattgctgcaggagcttgaaaagctgaaatgtcggccgtagcggcaagtagacggggctgcactataaccggtatcggtactacgatccggaggtggggcggtttgtaagcaaggacccgattggatttgcaggcgggctgagtctgtaccaaagctagggctacagcagggccatctgaatgcggaaggatttgctccaccggtcttgaataatttttcgtttaatagagaagcgatacgtggtcaggagcaacagctcatagacttccacggtgacgctcaaagtgttgatgggagtgcaagaaacatgaaaagactgagttgatgaagcttcttggcaccgttgaccgagtcgcttctctcttggccagttatcaacaccctatgctgttgaagcttaaggaatcgtgggagattgatcgcaaaaatactttcaaggattggtcgagggagtaaggcaagggctctgagagacaagcgattttatgagttacataccgaccaccgaaagaagagatttcataaaaatacaaccaaatcatcacaaatgatttcccgatttctttgacaaggataagaaaaatagattccataaaatgaatactatctcgtagagttatttttcgagcgtcggcgtgaagcgagtccggatggcgaagactcggtcgctctgcgccgaattatggatgagtttgaatttggaaggccgtgagtttgacgcagcccaaggcgataccaggtaatgattcttaccgccccagataaaccgccgtaatctgcgtcctctcgtgtcccagctcgcggctgatggtctgtggccctctgcgcaggtgtcagtgaccgcgccgaaggcccgccagcggtcagcgccctccccgtcaatgcttcataacgatcttgcgcgtaacgatgccgcagaccgtgcatgttgctcaggcccgccgctttgtactgtccgtcgtaggtcaagaccgccatcgccgctgtttaggttacgagtggcgtccactcgcgctacctttcccccaattacggccccagacacaccgccgcatccatgtacattcatgcccggattcccagccgattgcctgcaatcacagtggccgtgtcgaaacaggtaccgaaaccgacacggtcaccggacttgtagctatgcgtcaacccttcccctcgccctcatacgccagcctcaacccaccccgctccccgatcgcgcaatctccgtcggcgtcgcacccaccacgcgattcatccagttcgccatgtggctctggtgcgcaaacccggcttcgagcgcgatctggctgatactcagccggccttcgagcagcaacgccttcgcccgctcgacccggcgccgcacgacgtactgatgcacgggcatcccgagcgtttcgcggaacagcaccttgaaatgcgagacgctgatcgacacgagcgccgcgagttcggcaagcgtcatgcgccgctcgagattcgcttcgacatagtcgatcacgcgcgcggccgccttcggcgcgagcgtgcggcggcgctcgcgaaacgccggctggccgtcgaccagccgcgcgacgagcgccgtgcacaggctttccgcatagagcggatccgacgcgtcgtccgcttcgagttcggccgccatcgcccacgcgatgtgctgaaggcgcgggtcgcgcacctgcagccggcggcggatctgcccctgcgacggcttcagttcgagctgctcgacggtgcgccgcacgaacgtgtcgctgagcatgatgtgcaggatccggcagtcggcgctgtcggtccactggccgggcaagcccgccggaatcacatcgacgtcgccatgcgcctgaatgcgcgatacgcgttcgccgtcgcacacgcaatccgcgcgaacgggcccgcctatatgcacgccgatccggtgatgctcggccgccggaatccggtaggtgcccgcgcggatttccagcagcgacgcgccgaagccctgccagccgagcccgcggctggagcgcaggctgaccgggacgccgttgtccgtcggcgccgcgagaatcgcatcgctcatggccttcctccggtgaatggggatgtcgaacgcgcattgtgacgcgttttcggcccgcctgccgggcctgtcggcggctcaccccggctgagcagaaaaagatcatccgtttctgctcggggccatccttgcgtgtgcgccggcggccgccgtgccgcttacgatggccccatccgacacctacggagaccgtcatgcctcactgccttgcgcaacgcaccgcgctcaccgcgccgtcgcccgccgccacccgtccctcgtccggcccccgctcccgcaacgaccgcaccacgatagccgcccggtgcctgcgcatcgttggctggtaccggctcgaacggctgctcgcgtcgatccccgacagcaacgacgacttcgggctcgtctgaccggccgcacggccggcatcgtccacctacttgcgccgccgctcgtgcagtgccaccgtcgcgccgtcgatcaccggcgcgccctgcttgatcaggaaatcgcggaacagccccgtgacctgcgaaatgcgccggtcggcgagcgtgaccacataccattcgcgttcgatcgggttgccgggaacggcagttgcccgagcagcccggtgcgcagttcgagtgcacacgcgtgcaacgacaggaacgcgacaccgagcccggcttcggccatctgcttgatcgcctcgttgctcgacagttcggagcccatatggaagcggtggccggccgtcttgaagaggttctcgacggtcgagcgcgtgcccgcgccgcgttcgcgcacgagcaggtgcgcggattcgagatccttcagcgagatgcgcttgcgctgcatcagcggatggccaggcgccgcgacgaacaccatcggatgcttcgcgaactccaccgcatgcgtacgcaactccttcggcgcgctgcccatcaccgcgagatcgatttcatgcgtggcgagcatgcggatgatgtcgtcgcgatttccaaccttgaaataagtcttcacatgcggacgcgtcgcggtgaatttcacgagcagcggcggaatcaggtactcggccgtcgtgatcgcaccgattcgcagcgtgccgccgagatcgccggtcagcgcggccacttcgtcgccggcctcgctccacagatgcaggatctcgcgcgcatagcgcgacacgatctcgccggccgcggtcagctgtaccccgcgccccacccgctgcagcaaggcggcgcccaccgcctcctcgagcaggcgaacctgcagcgacacggccggctgcgtcaggttcagctcctcggccgcccgcgacacgctgccgagccgcgcaatcatgtccagcgccttcagctgccggaacgtcgcggtctttcctataagtgaatacatatgagtcgcttataaacattaaattgttcgagtgggttcgaaactatatcgtcggttcttgagcaatgtcatccgaatcgtcattcagcgggagccccacatggacaacaccacgcccaaccttgcaacggaccgcgcaccgcgcctgccgcgcatcgtgatcgtcggcggcggcgccggcggcctgcacctcgccacgcggctcggcgatacggtcggacgccgcggccaagccgaagtcgtgctcgtcgaccgctacccgacgcacttctggaagccgctgctgcacgaagccgcatcgggccatcgcgacccggcatcgcacacgatcgagtacgcggcgcaagcaaagcgccacggtttccgtttcgtgcagggcgcgctgcagcgggtcgaccgcgcggcacgcaccgcaacgatcgcggccgtgcaggatgcggacggcacggaaatcctgccgcagcgcgagctcgactatgacgacctcgtgctcgccgtcggcagcgtgacgaacttcttcaacgtgccgggcgccgcgcgccatgcgctgccgctcgaaaacctcgaccaggccgaggatttccgccggaagttcctcgcggcctgcacgaaggcgaatcacctggccgagcagcagcccgcgcggcgggcggcgccgatctgcatcaacgtgatcggtgcgggtgcgacgggcgtcgagctggccgcggcattgcggcatgcgatccagcagctgacgacgtaccgcttcaaggcgctggtatccgcacgcgacgtgcacatccggttgatcgaaggcggcccgcgcatcctgccggcgctcgacgcgcggctgtccggcaagatgcacgcgcagcttcgcgcgctgaacgtggacgtgctgaccgatacccgcgtggcggaagtcggcgcggatgccgtgacgaccgcgacgggcgaacggctcgcgagcgacatcacgatctgggcggccggcgtggcgggccccgcgatgctgcgcgaaatcggcgacatcgcgctcaatcgtgcgaaccaggtgatcgtgaccgatacgctgcagacgcccgacgatccgcacgtgtatgcgttcggcgactgcgccgcgtgcccgacggccggtgcgagcggcttcctgccgccgcgcgcgcaggttgcgtaccagcaggccgtgtatctggtcaacgcgttcgcgcgccgtgtcgccggcaagccggtggccggcttcacgttccgtgatgcaggcaccgtcgtgtcgctcgggcatgcgggcgccgtgtaccaggccgacctcggcgtgcgttcacgctcgctgatcgtcgacgggctcgccgcgatcggcctgtacaagttcctgtatcgcaagcacctgttcagcgtggtcggcgtgaagcgtgcgctgttccagtcgctgagccactggctgcaaagccgcaaccagccgtcgatcaagctgcactgagcgacgactcgcacgcagcatcgcacaacggcatatcgggcggccatcgctcgatatgccgtttttatatgcatataacggttgcatccacaacgtgcgcgactttggtgcatcacatcgaaaaccgtcgatgcgaggcatgtcgctcgaaaaatgtcgcgcgacacgcatcccgcgccggttctggctcacaccccgattcattagttaaaccgtataggttggataaaaatattaattggtcgcgttttcaggatcgacgctaaggtgtgtggcattcccgtcggcgaacggatcatcacgtttctgaagaggaatcaccgtggttatcgaagccatcgtcacccgtctcgacgctgcattcgcgcaaatcgaagcaacaccggattcgcatgaatcgcgccatcaacgcgacgcgatcatccagtggctcgaccgggcatcggaagaaggatatcgactcggtctcgtcacgacgctgccggccgcacggctcagcgacatgttcgaaggccagttcggccgcgcgaacctcgaccgcttctcggtcgtcgtcacggatgcaaatcagcaggactccggatcaaaccagcatcctttcgacgtcgcactgcaggcactcggcgtaccgcccgaacgcgcggtggggatcgcgagcagcgaaccggagcgccgggaagccgagcatttcggcctgtcgcgctgcgtgaacatcaccgacaccgtacgctcgatcgcatcggccggcctgcattgaccgccggcacaccggctggcgacggccggccaccctcgatccggcggacatccgacgattgcccgaccgaatcctgacattctgctgtcaaagtcgcttgcaacacttccgggcttgacccatccctccggaaacgggacgacgcgaaaccgcatcgtcccgcccgttgcacaccacgatgacacgcccgacccgcaccgccgccgccctcgccgttacctgcctgctgctcgccgcttgcggcgggacgattcgacaccgcccgcagcctcggccgacaacagcggctcgacgcccgcaccgcaaccgcaaccccagcccacgccggcacccgcgacctattaccagacgaagacgccataccgtccgcagcaggacgccgcgacgtacgaagcaccgcccgccggctacgcgcccgtctacaccgaactcgtcgcgcgccacggctcgcgcgggctgtcgggtttcaagtacgacggcgcgatctacgcgatgctggtcaaggccgaagccgacggcgccctgaccgcgctcggcgcacagctcaaggccgatacgtacgcgatgatgaaagccaatgcgctgctcggctatggcgtggcgggcatctccacgcccgggtacggcaacctcacgcaaaccggcatccgtgaacaccggcaactcgccgagcgcctcgcgcagcggctgcccgcgctgttctcggccgggaaccggcagatcgtcatcgtcaactcgggccaggaccgcgcggtcgacagttcgacctttttctcctcgtcgctcgtggccgcgcaaccggcactggccccggcgatcacgctgccggccgcgccggctggttatcccgcgagcgcgccggtcgtgcagccggccggcaccaaccgtttcctgctgtacttccactcgctgaagccggccaccgacctcgtgaccgatacgggcaatccgtactacgcgacctaccaggcgagccaggcctaccaggcttatgcgaacgacgcggcggtagccgcgaagctcaacgcgatcaaggccgcgccgcaggcggccgacgtcgcgcaaacggtgctgtccgcgctcgtgtcgcaggcattcatcgcgaagctcggcaccagcggctacacgttcgcgaacacgggcacctatgcgttcacgtcggcggacggcaagttcaccaacacgctgaagggcgacggcaagacgaagatcgcgacggctgtcgatgcggtgaacgtgctgtacaacctgttgcaggtcgcgcccgcgatgacggcggaaacgggcggcgtcacgatggaaaagtacatcggcgcggagcaggcgcagtatctcgcgtatctgcaggatgccgaggactactaccagaaggggcccggcatccaggaagcgaaccccgtcacgtaccggatggcgaaggtgctgcaggacgatttcttcggcgaagtcgatgcgatcgcgcgcggcgacctgacccgtgccgcgaagctgcgcttcacgcatgcggagatcatgattccgttcgcgtcgatcatgaacctgaagaacgtgttcgtgccgacgccgcaagcgcagacgtacacgtacgcgaacaacccgtggcgcggcgatcaggtgtcgccgatggccgcgaacatgcagtgggatgtctatcgcaacggatcgcggctcatcgtgaagatgctgtacaacgagcgcgaaacggatttccaggctgcgtgcgatggcgcgaagctcgcgccgggaagtcacttctatgactacgcagggttgaagcggtgttacgggtatccgtgacggacagcggcgcgccgtcagtccaccggatagttgagatcgtgccagcgcttggcggatttccgccggagccgaggtgaccggcggggaagcgcatcacggcaatcgcgtggagcgctttctcgtcgagcgcggaatcgccgcagctgcgccggaccttcagatcgcgcacgcgtccctgttcgtcgagccacacgcgcacggtcacctgccttcgcgacgaggtgttcggcacgccacgtgacaacaagcgatccatgagcgacacgatgttctccgtaaccgtcgaatgctgcgattatcaccgagcgcgcggcagtgcggcgcgcggcgcggcgtcaatgcttcgacacttcaggccgcacgaccgtacccgtgcgtaccgcccgtacgcgctgcggattcgcggcggttttccgtttcgggtcggtacgccccgcctcctgaggcctccgcaccttggccgcagccggctgcgacttggcggcaggcttcgcgtcggcatgcgcggcgaccgggccggtcgtgcgcgagcgaacgggctgccgaaccggctttgcggctgtcgcactgctcgccgccacggccggatgcttgacctgccgcgcgtattccttcacgtcgccgtcgctcatccacgcctccgtgtagaccgctgacgcaggatgtgcaagattgagataggcgaacgaggccacgagaaatgcacgcacgtgtgtgcgacgagtcgatgcggtaatgacgaatgctccttgcgatctggctcgacgcccctgtgtcggggccgtcgtggcggcacaataaaggagggccatgcacatcgcaagcatccaaccggcgatccaaactattcttaacgtttggatcgccccgcccgaatctcattcccgtccgtcgtcacccttgcgttcgacgctccacgtatggatcggccgatgccccggccgctcccattcgggcggcatccacagatgcttcagccgctgcaggatcggccccggcgcgaatacgtcacgccacatgtcgacgaattcgtgcaggttcagcaccaggaagttgtacgaacgaatctgctgcgtgatcccgtagtcgaccggctccgtttcctcgacataggtgccgaacaggcgatcgaagacgatcagcacgccgccgtagttcctgtcgatatagcgcggactgcggccgtgatgcgcgcgatggttcgacggcgtgtcgaacacgtactcgaaccagcgcggcagccgcccgatcgcttcggtatgcacgaagtactggtacacgagatcgaccgcgagcaggaacagcacgaccgcgggcgggatgccgaaccagactggcggcaggtagaacaggaacacgccgacgaacgcgttcagcagcgactgccgcatcgctgtcgtgaagttcatcacttcaccgctgtgatgcggcacgtgcgcggcccagaaccagcgcacgcggtgcgacgtgcgatgaaaccagtagtagcagcattccacgacgacgaagatcggcacgatcgtgaggccgttcaccggcacgtcgaacagccggttccggtagacccacgcgaagatcgcaccggtgaacaggagccccatcacggtctcggccacctgatagccggcgccgagcgacaggttcgcgacgatctccttccagcgaaacggctcacggcgcccgcgcccggtcatcaccgcgtattcgatcgcgaacgcgatcaggaagaccggcgtcatgccgatcagcaacacctgcttccagtccacgtcgttacccaggaacgcatggagccacgtcatcaactcggtcggcatgttcgcagcctcgatcaggaactggccggcagtatggtcgcgcgcgggtcgctgcgcgttgacacttgccgacgattacttgacactttccgccatgcccgccgcctccccgctttcgacgcagcgcgtctactactcgagcacctacgtgcggctgctgttcgactatctgtccgagcagggcaaggatgccgcgcgcgtgctgggcgaggcgcggccgcccgaggacgaccgcgggctcacgctgtacgcgagcgcgcactggcggcgcctgctcgaatgcgcggtgcacgtgctcgacgatccgctgctcggcctgcacgtcggccagcggatcacgcccgcccatctcggcgcgctcggctacgcgctgcatgcgtgccgcgatgccggcgccgcactcgcgcgctggcagcaatacgagcacctgatcgcgaacgtcgcgcgcatggaagtgcgcgtcgaggcggcgtcgatcgcgatcgaatggcacgacgcgcccgagccgctcggcccgctcgtcgacgaagtcgcgctcaccgccatcgtccagttcgcacgcaacatcaccggcacgcgtgacgggcccgacgaagtctgcttcgtgcacccgtcgcccggcgacgatcggccctacgtcgattatttcggctgcccggtgcggttcggccagccggtgaaccgcctcgcgttcccgctgcacctgctcacacagccgctgcgccaaccggacgacgcactgctgcggatgatggaacgccaggcaagcgcgctgctggccgagctgcgacagacggacgatctcgaacagtcggtgcgcgaagccgtcgcgcgcctgctgacgcaaggcgaagcgagcatcgaacagatcgcgtcggacctgcatgtgtcgtcgcgcacgctgcatcggcggcttgccgaactcgggctcaacttccggacactgcgcgaggacacgcggcggcggctcgcgatcgaccacctgaacgatccgcggctgaccctcgcggaagtcgcgtggctgctcgggtattcggaacacagcgcatttacgcgcgcctttcggcgctggaccggcgaatcgccgcagcagtggcgcagccggcagcccgcgcggacggcgagcgtcgcgcgcggctgagcgcggtacgcaaccgtgccgccgacgaactcgcgtccacccgcgcggtcgaacgagcatcgccggagaatcccatgaaacgcgttgccgctgtcgctgtcctgaccctgcttgccgccgtcagcttgccggcagccgccggtgcaacatccggcagcgccgggccggcgcccgttcaagcgcacgcgaacaactgcgtgccgtcccgcaacgccacgcccgacgcgcgcgcgcgtcgaaggcgccgccgatccgcgtgtgcgtcggcgattccaatacgcaactgaacctgccgtggttcctgaccgacgtcctcaccgccgtggacacgcatcagtcgggcggtgacctgctacgcaagatgcgcgacgatttctgaacgcggcccgcgcgacgcgcgggcaccgcatcgttcactcatcttcggacgcctgcagcacctgcgtgaacgtgccgaccatgccggcccacatcgcggggtcggcaatgctgcgcagcagcgcaagcgcttcctttcgttcgcctttcgaaagcggaccctgtgcgccgctgatggtgttgtagcgcggcgtgccgcgcgaagcgagcgcgcgatcgagcacgtaattgcgggcctgcccgtttacgtcgatccggatccacagcgaaccgccgtcggctgcggctgcaccatcgatcacgatgaccgtgggcacggtattttcttccatcccgaagctccggcgagacgtgcgaccgtatcgcgcggcgaccgaacgttgggccgcgggcaggtcggcaaagacagcatcccgaaagaatgtttcctgtcgagacacaatgacaaaattacaccaattgttgaataacaatatttcgtaatctctcatcacatcttatacttgccgcgcaccatcctcgtgccaagagacggtgtttttcgtcccggccgcaagaccatgcggccggggattttttcggtgcgttccgccaattcatatgcgccggatgcgcatgttcatggaggcaagcctcggaatgaacggccaattgcgacgaggccgtcacggatgtccgtcgcgaccgtagaatcgatcgcatcgagatggcggcgcgcatgacgcaggcgtgccgtcgatgtatcgaccggttcgacttgcctctcccaacacacaacaccaaaggcgaccgcgggaatgtcggcgttcacgccaggctcgaaaccagttttccagcgcagcggcgcctggccgcgggtcgtcttgttcgtcgccgttatcgtttgcgtactcgtgccggcattcgcgatcgcgcttgccgaccgctatgcacgcgataccgtcatcgaacatgaacgcgtcgtggcgaacgacatcgtggcatcggtcgaccgcatcctggacggcgcgcgcctgcgacatgtggacgaactcaccgcactcgtcgggcgaccatgcgcgacggtattccggacgctcgccgagataggcacacgcctgcgctacctgcgcgccgtcgcgctggtgtacgacggccgtgtcatgtgctcgtcggcgctgggagcaatcgacttgccgctgggcgcgtacacgcacgagccggaaccgggttcgacgctcgtcacgctgctgcgccagacgccgttccagcagggcatcccggtgctgcccgtgttttacgccaccgcacccggcgcgggcgtgctctacctggtcgaaggcgactacgtggccgacgcgctcgcgcacggtgcccgctacgggacggaaaccgcgacgctgtcgatcgcgggttcgggccatctcgatcagcacgggaagtttgcgccggaatcggccgcggaacccgcaggcggcagcacgatcgtgtcgccccgctggccgttcacggtatcggttgcggcatccctcactacgcgtcgcaggttcggcaccactatcggctgatcggcatcacgatcgtgctgctggcggatggcctcgtgatggcggcctacctgctggcgatggcaccgcgccggctgttgctgaaggccgtgcgcaacgcgctcaggcgcgacgaactccatgtcgtgtaccagccgatcgtcgaggtcgggacgcgcaggaccgtcggcgtcgaggcgctgctgcgctggcagcatccgaagtgggggccatcagcccggcggtgttcatcccgcaggtcgaatcgagcgcggtgctgccgaaagtgaccgaattcgtgctgcggaccgccgtgtcggaactctccgcgctgacgccgtcaatgccgctgcgcatcgccgtcaacatcgcgccgaaggatctcgagcgcacgcggttcgtgtccatcgtcgagaacgcgattcgcgcactgccgcccggctttacgctggtgctcgaagtcaccgagcgcatcctgctcgagaagaacgcgcggaccaccgcgatcttccatgcgctgagagcgaaaggcgcgaaattcgcgatcgacgatttcggcacgcatcacagcaatctcgacatgctgtcgcgttttccgttcgactacgtgaagatcgatcgccagttcgtctcgcaactgaacggcggcagcgcgggattgatcgagggaatcgcgtccgttgcgcatcactacgacctgaagatcatcgcggagggcgtggaaacggaagcgcagcatcgcgcgctgcaaacggtcgggattcagtatgcgcaggggtatctgtatcagcggccgcaacgggcagagcacttgaagcaggatgtcgcgtgggtgtagggcgccggtgcgtgcgccgatgcgcacgctgccgaatcgccgcgggtcgtcttgtcgtgcacgcggatcacgccatatccgcttgcgggtttcacgccgacggcatgccttgcgacggtccagcggtctcgcgacgcgcagcggcatagaacacgcggaaccacacccagtaggccgcgccggttgcggcgagaacgacgaccggcatgatgccggacatcaggctggctattccgagcacgtcgcccacgaggcgcagcaccgcataagccagcagcaggaccgatgccatcgacgcaagcgacgcccccagcagacgccggacgtgcagtcgaccgagatcgcgaggcaggccgagcatcgcgcctgcgaagacgatcgcggcgggaacgacgatccccgacgtagttcagcatcacgagcttgagatcgtcgtcgaaatagtcgagcaggatcatcacggcctgcgtcatgaagagcagcaatacgctggcaaacaaccaggccgcgagacccgcaatgcgccgccgcgcattgccgcgcggcgccccgggcaacgcgtcgttgcgaaacaggtgggtgacgaaccaccacgcaagccaggcgacgagcgcatagaggacggcattcaccggcgcgatgagcgtcacgatgtgcgtcaggctgagggaaccgccgcgcaacatgcccacgagcgcctggaataccagtacctgcgtggcctgccagaccagcaggcacaacgcaaaggccgtcagcggcaacgcggggcgacggaatgcaagctggtcccgatactctccgtgccagcggacgatcaggaacaccaggccgcttcgaaacaccaggctcccgatgaaagtggacagttgcacggccagcatattcacggacggcgaagacttcgtcgaccacacgtagaggccgatcagaaattgcgccgtggtaatgaccgccgcgatgaacgcggcgataccgggtaaagaaatttgccgggaggaagcgttcatggggagtccggggtaaatgggttcatcggcaatgcgtgcggcgccgcacttccaggcaaacagaacagccgcgccatccccgcagcaacaggacggccgggcatccgccgggaaaatgcgcgtgtgcgtttcgtgcggtgcttccgggcagcgacccacggcaccaatcggggcgacacaccggttgcgaccgtttccgccgaaccggctgtccggtcaagaccctcgagcgtgtcgcgcagaagggcccgccccggcagcccgaggacgagcgacagcgagtcgaatgcaagcgggatcagtggatgcgtgcggttttgcggtcgattgccttcgctcaggtcgagcgacaggccggtcgactgcggcatggaggctttcaccagcggcgactggaaacgaggctggcgaagtcaggtcggcatgcgtcatgcgctcccacgcagcttgcgcgatgcgttggcacgtcatcgcgaccgatgcaggactgcccggccctgcggtggggaatcggagcacgattgccaagccgggaatggaacgcgacaagcaatgcttgccgagccggccgttccgcaattgcttccatcatgcggtgcgcattcatggcgcctctctcagaatgatgttgttcttgaccggcgattctacgaatgatgattccgtgacgtcaatcgggccggattcgtcagcatgccggcggatgatcgggatcggacaggcatgtgtcccgataggcgtcgtcgacggcacgcagaaacgccttccgtccgttctccaatgccgtggccgtgtgcgcgtccggcgagacaggcatcacgcggccatcaggcgacatcgaatatccgagatcgacgaacgcatcgtccggcgcgcgcttcgttccgatccagtagccgatcgaaaccgagctggcaacgccggtcgcgccgttgtaacccacttcgaatcgtccggccttgaagatgcgcggccgcatttttccgcataggccagcacttcggcaaccgttgcgccatcttttgtccgatgctgcctgaccgcctgtatccagttggcctccgtggtcgccggcagtgccttcactttcgggaagcgcatatcgcacgcccgcttccacacaggcaggccgcaacgacgacgcagccggcaacgcgtgcgacgcgatcaatcgcgagtttcattcaatgatccttgacgggttcaatcgagcccgaatcttacgatcatcggcccggatgccggaacggtatcgcgcaccccgtcccggcactgccccacccaagcgctgaaatcggccgcccgggcatccacgacgagcgggcgtctcgacagcgtgcgagcagggtcccatatggattcaccccgtcgatgccgcgacaccgcatttcgtcggcgcaaaaaccccgggaacccgatgcgcatctgccgcgcggcgcttcagtcgaacgtacgcaccacggcggacgccttggttgcgatcaaccagctgccgtccaccttgtgcatgacaaagtgatcgttaaagagccggttgccgatccgcacccgcaccgtcgccgttgaaaggccgtccgacacatgcgccatcgagaggatcgcctcgtccctgggcgcgccggtcgatcgcggactcggcctcccgttgatgagcgccgcatactcgtgcgatgccagcgtgcgaaaccggccttcatcgagccactgaatcatgcagctcgggtgaaaaaccttgtcgaagtcgcggctcttcggctcataagccaaattgaagtagtcgtcgatcaacgcgactacggcctgggtctgggtcatggctggctttcctcgatagtgaaccgctcgtatagtgagcgatcgcccccgccctcggctacggcgacccggttatcgctgccattacaggaacacatggatcatggaagacctcgacggaggactggtaagcggcttgcttgtccttgcggccctggccgaatccgggagcttcggtcgagcggcctcccgcctcggcaagactcagcccgcggtcagtcgcgcgatccagcggctggaggatcgcctgcgcgcgaagctcgtgcatcgcaccagccggcacgtcgaagtgacggacgcgggccacgacctgttgtcgaaggtgctgccgttactgcaggggatcgaggaagcgaccgccggcacgtccggccagacctcggtcgccagcggcacgctccgtgtggcgtgcgatgccgcattcgcccgccttgtgctcgcgccggagctcgcccggttcatgaaggaacaccccgctctgcacctgaagctggagacccggaacgacctctcggacctcgtcagcgacggcttcgatctcgccatccgctttggcccccatccgtttccaccttggtctgtcgaaggctgtacagcccgcgggtgctgacggtggccgcgccgtcctacctggagcgacgcggccggccgaggtcgccgcaggatctggtcgacgacggccacgaatgcatcctggccatcgccccggctaccggccgccccttcgactgggagttctggcgtgacggcgaaaaagtgaaagtggccgtaaccggcagcctgaccgtcacggatgcgggcaccaagatcggcgcctgcgttgcaggcttcgggatcgcccaggtgatcgacctcggaatcgacacgcacctgcgtgccggcacactggagccggtgctgaccgactggtgcgacgagacgttcccgctatatgtctactaccccagccggaaccacgttccggccaaggtgagaacgttcatcgacttcgtcgtcggcatgatgcccaggctgcagtccaatggctacggcgcgtgccggcgaccgccatccgccgtgctcgaaacgctgcgtcgcgagtagtcgccttctttccgtcgcgcgccggccgtcaaccgcctcgaaaaacccgaacgccagccggcacgcggaagatcgcgcaacgcgcgccggcttcctgccacctgttgccacgcgcgccccgtcggcacggccgccattcaagcgctaaaatccgccgcctgggcattcacgacgagcaagcgttttgacggcgttcgagcagggtttcatcctcacccgccattggcgggacaccgcatccggcatcgagatcgagttctggctggcaaccgaacacggtccgcgccgcgtgcgcctgcgcccgcaggaagccgtcgcgttcatccccgccgaacagcaggcgctcgccgaacgcacgctggccggcgagcacgacgccgagttgcgcccgctcgcgctgcgcgatttccggcagcgccccgtcgtcggcctctattgcaagcgctatcgccatctgtccgggctgcaaagcgcctcgccgcagcgggcgtggacgtctacgaagccgacgtgcaaccgcccgaccgctacgcgatggaacgcttcatcacggcatgcgtgcagtttcgcggccggcccggccgcgacggcacgctgaccggcaccgagctgaaagccgcgaccggctaccgcccggccctgcgctgcgtgtcgctcgacatcgaaaccagcgtccacggcgagctgtattcgatcgcgctcgaaggctgcgggcagcggcaggtctacatgctcggcccgccgaacggcgatgcaagcagcgacgcaggtacgcgggacttcgacctcgactattgcgacagccgcgccgcgatactcacgcggctcaacgactggttcgaaacacacgatcccgatgccgtgatcggctggaacctcgtgcagttcgacctgcgcatcctgcatgcgcattcgagcaatacggcatcccgctgaagctcgggcgcggcggcagcgtgctcgactggcgcgcgcacggccagcagccggaccacttcttcgcgggcgcggccggccggctgatcctcgacggcatcgacatgctgaaatccgcgacgtggacgttcccgtcgttcagcctcgaatacgtgtcgcaggcactgctcggcgaaggcaagtcgatcgacaatccgtaccagcgaatggacgagatccagcgccgcttcgatcacgacaagccggcgctcgcgcgctacaacctgaaggactgcgagctcgtcacgcgcatcttcgacaaggcggacctgctgtccttcgcgctcgaacgcgcgagcgtgacgggcctcgcggccgatcgcaccggcgggtcggtcgcggccttcacgcacctgtacctgccccgcatgcaccggctcggctacgtcgcgccgaacctcggcgacgtgacggggcaaaacagccccggcggcttcgtgatggattcgcgccccgggctgtacgactcggtgctcgtgttcgactacaagagcctctacccgtcgatcatccgcacgttcctgatcgatccggtcgggttgatcgaagggctcgcgaatcccggcgacgacgcatcggtgcccggctttctcggcgcgcgcttctcgcgtaccgcacactgcctgcccgatatcgtgcgccgcgtgtgggaaggccgcgacgatgcgaagcgacagcgcaacgcgccgctgtcgcaggcgctgaagatcatcatgaattcgttctacggcgtgctcggctcgaccggctgccgctttttcgacccgcgcctcgcgtcgtcgatcacgatgcgcgggcacgagatcatgcaccgcacgcgcgagctgatcgaagcgcagggctacgaagtgatctatggcgataccgattcgacgttcgtgtggctcggccgcgcgcacgacgacgatgaagccggcgccaagggccgcgcgctcgtcgaacacgtgaaccgctggtggcacgcgcacctgcgcgaccagttcgggctcgagagcgcgctggagcagtacgagcggcactaccgccgcttcctgatgccgaccgtgcgcggtgcggaagaaggcagcaagaagcgttacgcgggcctcgcggcggcggccgacggcggcgaggatctcgtgttcaaggggctcgaaacggtgcgtaccgactggacgccgctcgcgcagcagttccagcgcgagctgtatcgacgcgtgttcagccgcgagccctaccaggacttcattcgcgactacgtgcagcgcacgctggccggcgaattcgacgaccagctcgtctaccgcaagcgcgtgcgccggccgctgcgcgaatacgagcgcaacgtgccgccgcacgtgcgcgcggcgcggatcgccgacgagttcaaccacgcgcagggccggccgttgcaatatcagcgcggcggctggatcagctacgtgatgacgacggccggccccgagccgctcgagacgatgcgctcgccgatcgactacgcgttctacctgagccgccagttgcagcccgtcgccgacgcgatcctgccgttcctgcgcgacgatttcgaacgcgtgatctccgggcaggggcagttgttcggcgattgacgacgtggcggcacggcggcatggcacgcctgtcgcccactgtggcgcattccggaaacacagttcacccggattcggcatttatccggccggcacggattcctaaacttgcttcgtcggttcgctgaaccgccacgcaaccgtctgaggaaatcatgaaatcgatcatcgccaccgtcgtcgtcgccaccgctgccgcgactgccctgctcgccgcgccggccgtgtcgtacgcgcagtcgtcgtcgcactcgacgctcacgcgtgcgcaggtacgccaggaactgttcgacctcgaagccgtcggctacgacccggtcgccagcaacggggacaactatccgggcgacatcgtcgccgcgcaggagcgcctgactgccaagcgtctcgcggaacgcaacaacgccgctgccgcctatgggccgggcggcacgccgggcacggatgcgggcgcaccggcagtcgccgcgccgcggccgtaacgcgcggccggaagcgccggcgaagcaggccgttgcgcgccgccggccgcacatccggctagaataccggcctgctgcgcgtcctgccgcggccggaggacattcatcatgaccgcacgacgcggtgccgcggtcgtcatcgcgcccggccacgagacagccagcctgtcgaaagcccagaagacgttcaatacgctcgtccagcagatcgagacacggcgcgaacgcctcggcgcatgggacgccgtgacgccggccttccagaagaaattcgtcgacgggctgctgccgctcgagcaggcagcgacggcgttgcggatcagcttgctcaaccggctcgacgacgcgttcctgcaaaagggcttgagcaaggcggagcagcgcacgctgtccgacgtgatcgcgaacatggcgcgcgacctgctcgacgtcagcgacgacgcgcagttgaagatcatctacaaccggcaccgcgcatccggcgacgacgaccgtacggcagccgatcgcgcacggccgaagcaggcaccggagcccgcccccgcaccggaagacgatctcgacacgctgtcgcccgacgaactcgccgagcacatgcaagccgagctggacgaacagttcaggcgcgacatggccgagcacgaggcccgcgaggcgcagcgcgcgaaacgcaagaaagcgccccggcaatcggcggcgcaagcgaggcgcgaagccgagcaggccgaatcgagcaagtcgatccgcgacgtttatcgcaagctcgcgagcgtgctgcatcccgatcgcgaaaccgatccgaaggaacaggaacgcaagaccgtactgatgcagcgggtcaaccacgcgtatgcgaaaggcaatctgctgcagctgctggaactgcagctggagatcgagcagatcgaccggcgcgcgatcgacggcctcggcgaagaccggctgatgcgctacaacggcatcctggaggaacaggtgcgcgagctggaccaggagatccggcacgtcgaaacccacttccgccgaacctacggcatcgcatcgtccgtcaagatcgcgcccgatacggtcatgcggatactgacgcgcgacattgccggcatgcagcgcagcaaccaggacctggccatcgcggtgcgcgaattcgacgacccggacaacgtcagggaatggctgaaggagatgaagcgccggccggcatcgtcccgcttcgacgacgattcgtactgaacgcacgcgcccggcgcaacgtcggcacggcgcaaagcagcgcaccgcaccgcgcctccgtcacccgttcacgcccggtgccccgagatcggccccgcttcgccggtcaggttgaacacgctgtcgatccacgcgagaaacgtcgagaacgtgaaatccgaccactgctgcgtgcggaacgccttcatcaccggcgtctcggccgggtcctgctggttcagcaggttgtcgacgaaggtgtcgatatccgcgtcggtgccgttctcgtggatccccgacccggtgaagctgaccgccgtcacctgatggttggcgatgaagtcgttgcgcgcccacggcatgaagtagccgaagttcggcaacgggttcagcgtctgcttcagcccgtccagctccttcccgaacatcgcgagcgacagcgcgtccttcgtcgcgtcgtccggcgccgcgatcacggccggcacgaacgcgcgatagtgatacgcggcgatgatcttgtcgcgctggtagctggagaaaccgaagcgatcatgcggaaaggtcgccgacagcgccgcgtacgcgctccccatgttgccggggtcgaaccggctggtcaggcggctgttcacggtgatcatcccgtcggggcccgtcatccccactcggtgcgcacgcggtcgtacaggccgaccgacggatgcgtggccgcgtccgcatcgaacggcgtgttgaacaccgtgccggcgtcgtcgagcagcgaactgtgcgcctgcggttgcagcgtgttgcgcagcgtcgcgtagttcgcgagcgtgccgtagccgcccgcgctcatcccgtacacgagcagccggttcggcttgccgaagccgtgcgacgtcagccactgcgcgacggcctggatgttcttcagcccgctgtagtgctgcaggcgccagtcgccggacggcgacgtgtagttgcgcaccgcgctgcccatgtggatatctccggtgcaatagggcacgaaaacctgtgtccattgctgcgtttcgaccttcggctcgccgacgagaatgtgcgcgagatccatgcgcgtcagcagcggcgacaggaacgacgacagcaggctctcgttcgcggtgccgttcatgtagttgtgcgggatgccgtccgggttgaagccgccgaggccggcctcggcaccggtcgacgtctgcgtgcaggtgtcgtagtcccagcacgcgccgcccggctccatcatgtacagcaggttgtccgactgcgcgcgattgatgtagaagcgcatcggcgtgccgttgccgcacgatgcaccggtgctctcgggcaacgtcacttcgtaccacgaataataaggaaccgacggatccggcatcgtcgtatcggccgcgtgaccgttcagtgccgcgcaaccgagcagcgcggcaacggccgcgcgcagcaggcatcgtgctgtggacatctccctccttgtcgatggacgtgacgcggccgccgggcgccgccccggccgcgcggattcggcgctcagtgcacgccggacggtgaagcgccgtcgaacagctggacgcgcagcgcctgcaggcgttgcgcgatgacggcgtgctgctggtcgggatcgggaatgctcgcctgaacctgccggacgacgtcgcggctctgctgttcgtacgagagatagcgcgggtcctgcgccggcgacgggccgaccgtccgctgcgcataggtgtcccattgcgcgcgcatcgaccggatcgccgcgccgcgcgtcgcggggtcggcttcggtgtcggtcagcagcgccgcgctcagcgcttcggcctgcaccggcacgatctcgttgcgcgcgacgtggtcgggaagttcgtcgagaatccggcgcgcgagcgcgtcgcgctcggttggcggcaggctgttgcggcgatcgccgtaagcggcgacctcgtcgcggaagcgcgcgaatgcgacgacgcgcttcacttccgcgtccgcatcggggcgcccggcaaggctgcggcgcagcgcgtcgacgtcgagccgtcgctcctcggggcccggtgtcgcggcgccgacgccggtaccgaacgtatcggccgcgccggaccgcgtgcccgccgtcgcgaccggcgtgccggacgacgcggcttgcgccggtgtcgccgcttcgtatcgccagatcgcgacggcggccacgccgatcgccgcgatcgcgcccgtgcgccgccagagtgccctgttcttcttcacgtcgcctcctcgtcacgtcatgccgttcttcgccggtgcatccgcgagtaggttctaggtcgaatccggcatgcagtcaaaagcggcactagaacgcgggcactaaacctgcgcgcagcggcgatggccggcaagacgtttgaaacgcatttcgttgtcgcatcggcacgcgcgtgatgtcgagcgtcgtgcccgtccggcggtggttcgcgccggcacgcgcgatgtgcgccgcgacaccaagcaagcaacgatccaccttcacggggcgcgacgctcacgcgtgcgtgtggccgatacggatggccggataagacccgtcgaacgacccgctgagcgcttggtcgtcattttggccggccctatgctggtttccgacacgcgccgaacggtcggcgcggcacacacccacccagccgagcccgctccatgagccgtgcagaccttccgcatcgcgcacccgccgccgtccacgactatccgacctaccgcgacgcgctcgcgggctgccgccttcccgccgcattcgtcgatctcgactgcctcgacgcgaacctcgccgacctgaagcgcgcgcgcgcggcctgccgatccggctcgcgacgaaatcggtacgctcgcgcgaactgatcggcgcggtgctcgccgccggcccgttcatgcaggggctgctgtgctattcggccgcggaagccgcgtggcttgcggacggcgggttcgacgacatcgtcgtcgcctatccgaccgtcgaggccgacgaccttcgcgcggtggccgcgcagctcgggcggggccgctcgatcacgctgatggtcgacgatgccgcccaggtcgacgcgatcgaccgcctcgcacgcgcggaaggcgtgacgatcccgctcgcgatcgatctcgacatgtcgtccgcgtatccgggcctgtatttcggcatgtaccgctcgccggtgcgcgacgtggccgccgcactcgccctcgcgaaccgcatcggcgagcggcagcacgtgcggctcgacgggctgatgggttacgaaggacagatcgccggcgtggccgacacggagccgggcagcggcgcgcgcaacgcgctggtgcgccacctgaagcgccgctcggcgcgcgagatcaacgcgcgccgccacgcggccgtgcaggcgctcgcggcggcgggccacacgttgcgcttcgtgaacggcggcggcaccggcagcttcgaaagcacgctgggcgacgcatcggtcaccgagctcgccgccggctccggcctctacgcgccggcgctgttcgatcactatgcggcgtttcatgcgcaacccgccgccggcttcgcgctgccggtcgtgcggattccgcagccgggcatcgtgacctgctcgggcggcggctatatcgcgtcgggcccggccggcaagagccggctgccccgcccgtggctgccggccggctgcacgctgatcgacaacgaaggcgcgggcgaggtgcagacgcccgtgcgcgtgccgcgcggcgtcgcaccggcgatcggcgatccgatcctgttccgccacgcgaaggccggcgaactgtgcgaacgcttcaacacgctgctgctgatccgcggcggccgcgtggtcggcgaggcgcccacctatcgcggcgaaggcaagagctttttctagcgggccgcgcggcccgtcgttcaaaccgttcaactcattcgatcgacaaccacggagacaatgccatgtggcgtaactggtcgggatatgtctgcagtcctgatgcaaccgtgtcgacgcccgcgtcgcatgccgcgctcgcggcggtgctgcgcgacgcggcggcagccggcgccaccgtgcgcgcggccggcgccgggcactcgttctcgccgctcgtgcagaccgacgacgtgatcctgtcgctcgacgcgatgcagggcgtgatcgacgtcgaccgcgaccggcgcgtcgcgcgcgtgcatgccggcacgcggctgcgggcgctgggcccggcgctcgccgcgcacggcctcgcgatggagaacctcggcgacatcaacgtgcagtcgatcgccggcgcgaccagcaccggcacgcacggcaccggcatcacgctcggcaacctggcgacgcagatcgacagcctgaccttcatgtgcgcggacggcagcgagattcgcgcgagcgccgacacgcatcccgaactgttcgccggcggccggatcgggctcggcgcgctcggcgtgctgaccgagatcggcctgcgcctcgtgcccgcgttcaagctgcgcctcgagcgcggcggcatgcggctcgacgattgcctcgctcaggcggacacgctgatcgccaggcatcgctcgttcgagttctactggttcccgcacaccgacgccgtgctgaccaaggcgtgggacatgaccgacgagccggccgacgcggtgcactgggcgagccgcgcgtccgagtcgttcctcgagaacacggtgttcggcgcgctgtgcgggctcggccggcgcgtgccgtcgctgtgcccggcgctgagccggctgtgcgcatcgaccgtgtcggccggccggcacgtggatgcgagctacgcgatgctgtcgacggtgcgccgcgtgcgcttcaacgaaatggagtggtcggtgccggccgaccgcggcgccgacgcgctgcgcgaaatccgcgcattcattgcgcgccgcagcttcccgctgatgttcccgatcgaataccgctgggtgcgcggcgacgacatctggctgagccccgactacgggcgcgacagcgtacgcatctcggcgcaccagtatcgcgggatgccgttcgacgcgtatttctcgggcgtgcaggccatctgccgcaatcacggcgggcggccgcactggggcaaggtgcatgcgatgaaggccgccgagctggcggcgtgctacccgcactgggacgatttcctcgcgcgcgagcggatggacccgcacggccgcttcctgacgccgtacctgcgcacgctgttcggcctgccgcaaagcgcaggcgcaaacgcaagcgccaccgctcgcgccacgccggcccgccggggacacacccgatgcacgaaacggccggcgtcgcgcaagaccggccgcgatccagccaggaggcctcatgagcacagccacgccgcacgcggccgcgcagtcgcgtcccgatccgtcgaccggcgccgtcgtccgccttgcgctcgcgttcgcggccgccaccaacggcctgatcctgtcgccgttcctcgtcgcggcggtgatgacgcgcttccggctcgacgagggcaccgcgaccgcgctcgtcagcgccgagatcctcggcatcgcgatcagttgcgcgctgctgtcgcaccggatcgcgcgcgccgcgcggccgttcacgctggccggcctgatcggcacgatcgccggccaggccctcggcgcggtcgcgcccggcatcgtgtcggcggcgctcgcacgcgggatgacggggctgttcgaggatgctgttcgtcgtcgttgcgtccggcgtgtcgcagcgcgcatcgaccgaccgcctgtgggggcaaatcaacctgctcgcgggcgtcgtcaacggcggcatcctcgtgctgatctccgcgctgccggccgcgtggctcgggcgctgggtgttcgcgctgctggccgccgtcgtcgccgtgctggcgcccgcgatccgcggcatcgacgcgttcgcgagcgcgcccgcgcaggcccgcttgcgcgccggcacgctgccgtggcggccggtgatcgcgatctgggtcgtgacggcgctcgtctacggcgtgcaggcgtcgcaatgggcgatcgccggtttcgtcggcgagcgcgccgggctgtcgcccacgacgatcggcgtgctgctgtcggtgtcgtccctgctcggcttcgtcggcgcggcgattccgtcgcatccggccagccaccggcaccgcctcgcgctgatctgggccgcgcagctcgcgatgatcgcgtcgatcgaatggttcttcggcgcgcgcggcggcagcgcgtacttcctgagccagttcgtgctgaacagtgcgttcttcgtgatcgtgccgttcctcaccggcatgctgtccgacgtcgacccggacggctcgctggtcgcgcgcacgctcgtcatcacgttcttcgcggccggcatcggcaccgcgctgtcgggcgcgctgctcggccgcttcggcggcacgcgcgtcgcccacgtgctgtgcgtggccgtgctggccgccgccccgttcgtgcggctggcgctgcgccgcgcggcacccgctgccgtggccggcgcggcgccctgaccgcagtgcgccatgccgtggccgcgacgcaccacgagaatggccgccgcggccttggcccgcgcaaatttggctttctacagtcgttcccgacggcgcgagccgtccgtccccagttcgatgcggagtccagaagaatgaatcgtcacgatagcgttcgcgccgcgtgctgcgcgatgatggtcctggccggtaccggtgcgcacgcgcaaggcaacgtgacgctgtacggcgtgatcgatgccggcatccgctacgaaacgcacggcgtgtcctacggcgccgacggcacgccggtgtcgacgggccgcaagatctcgatggccgacggtggcggcctgacggaaagctactggggctcaagggcaacgaggatctgggcggcgggttgtccgcgcagttcaacgtcgaaagccacttcggccccaacagcggcgccatcgtgccggccggctcgccgaatttcttccaggtcgcgtacgtggggctgacgtccactacgcttggccagctctcgctcgggcgccagtacaacgtgccgttcgagatggcgtcgctgaccttcggctcgaacctgtgggccggcccacaggacccgtacttcaacctgttcaagccggagcagacgatgctcgcgggcgcgcgcaccagcagcatgatccagtacggcgcgcagctcggcagcttctacctgctcgcgcaatacgcgccgggcggccacgcgggcggcggcgtgcgcggcggccagctcggcgcggccgccgcgtatgcgccggacaaggggccgttcacggtcggcgcatcgttcatgcgcagctgggacgacgtcacgcacgggaaattcgacatctacacgggcggcggctcggtgacgatcggcaacgcgaccgtcaatgccggctacatcgagaacgcacgcgacaacgacttcacgtcgttcgagaacggcccgttcagcccgaccgatctggcggggctcggcatcatctcgcccgcgcaggtcgtcgacccgaccgtgcccggcgggttccgccgccgcaagatggcgctcgcggggctcacctaccgcttcacgtcggcgttcacggcggccgtcaacgcgtggtggacgcagcaatccggttatacggcagatttcgacggccgtgcgcgccagttccaggtgatcgccggctacagcctgtcgaagcgcagcatgctctatgcggaagtcgactacgcaatctaccgcggcgggctggtcggcgcgcaattggtcggcgtgaacgggcaggcgccgagcaccggcaccacgcagctcggtgcgacggtcggcctgcgtcactacttctgaagcggggccgcgcgggatgtgggcgatcgcggccggggcggcaccgggtctccggccgggcgggacgagtacaatccatggaaaaatacggagcatccatggacgataccgaccgttatacgacggcgaatctgccggtccatctgttgcggtgcctcgcggagacaagcaaggaactgggcatcgaccccacgcggctgtgcctcgggctcggcttcgacgtcgccgacctgtcgaatccgtcgtgccggatttcattgcgccaggcgagcacgatgatccgccgcgcgctcgagatggcgccggggcgggcactcggcctcgaactcggcacgagcgagacgatcgcgtcgatcgggctggtcggctatgcgatgctgacgagcccgacgctgaaggacgcgatcgtgaccggtatcgggctgcagcgccacacggggccgctgatgcgcttcgacgtgatgtcggatgcgcgcacgctgtcggttcgcgcgaccaacgtcttcctcgagcccgacatcgaggcgttcctcgtcgaggaggcgttcggcagcttcatgaagatcgggcgctcgctcgtcggccccgcgttccagccgaaggtcgtcgatctcagctacccgccgccggcctatgcggagcaatacgcccgcgtgttcccgtgcccggtgcggttcgaacaggagcaaaacctgttttcgtgcgacgccgcgctcggcaaccgcccgatcgcgacccacgatccgctcgcgcatcgccaggtgctcgaattcctgcaggacgcgctgccgcccgaacccgaaggcaccgaatttctcgaatcgatcgaacggatcatgcggcgcgacctgcggcatgcgccgtcgctcgccgagatcgccgcgcagctgtgcatgagcgagcgcacgctgcgacggcggctcgccgaccagggcgtgtcgtaccagacggtgatcgacacgatccgccgcaaacgcgcgttcacgctgctgagcaatccgcggctgtcgatcgaggatgttgcacacgaagtcgggttcagcgacgcgcacaacttccggcgcgcgttcaagcggtggacggggcacgggccgagagaggggcagcgggcggcgatgtagcggcgcggcctgcccgcacgacgcgatgaccgttcgcgtgcgacgtacgactacgcgtccacagccccctgctgcaacaacaccgcgtcgcgcttctccagcagatgccgccgcaggatcgccgcgagcgccttgccgtcgcgcgcctccagcgccttgatcatctcctcgtgatcgtgcaccgcgcgatcccatttctcgacgtgctggttcgagcggaaccgcatcgacatgatccggcgattgatcgactggtacgtggcgcgcagcgccgagttgcgcgcggcctcgttgatgcggtcgtggatttcctggttgcggctgtagtagccgggcaggtcgttctgcagccggcacgcgagcatcgagtaatgcagcgccttgatctccgcgagctccgcttgcgtgatgcgctcgcaggccagctcgcctgaaaacgcctccagccccgacatcagctcgaacgtctcgcggatctccgattcgctcatccggtacacgctcgcgccgcgattcggcgacagcaccagcagcccctcggccgccagcaccttgaacgcctcgcgcagcggcgtgcgcgagatgccgagcgtctcgcacagctcgcgctcgttcagccgcatgcccggcgcgagcacgccttcgacgatgaatttgcgcaggtgctcgacgaccgtgtcgtgcagccgctgccgctccagtttcggcagtgccggcgcgccgccggcctgctccagatcattcaaatcttgcatgcaaaatccttccttcttgcttcacgcgattctacttcaactcgcccgacccgaatatctccccgccaacgccgggtaaacaccggcattttcggcgaaatcagtccttgggtttgccgcgatcgctctgctaaagtattttgcatgcaaaattcaaaatgcaaccaaggagacagaacaaccatgctgcaactcgactttcatccgtccggccgccatttcctgcagattccggggccgagcccggtgcccgaccgcatcctgcgggcgatgagctatccgaccatcgaccaccgtggccccgaattcggcgcgctcggcctcaaggtgctcgccggcatcaggaagatcttcaagaccacgcagccggtgatcatctatccggcgtcgggtaccggcgcatgggaggccgcgctgaccaacacgctgagcgccggcgacaccgtgctgatgtacgagaccggccacttcgcgacgctgtggaagaagatggccgacgcgctcggcctgaagcccgaattcctcgggctgccgggcatcgaaggctggcgccgcggcgtgcagcccgacatgatcgaggcgcgcctgcgcgccgataccacgcacgccatcaaggcggtgtgcgtggtgcacaacgaaacctccaccggcgtcacctccgacatcgcggccgtgcgccgcgcgatcgacgcggccggccacccggcgctgctgatggtcgacacgatctcggggctcgcgtccgccgactaccgccatgacgaatggggcgtcgacgtgacggtgtcgggttcgcagaaagggctgatgctgccgcccggcatcagcttcaacgcggtgtcgccgaaggcgctcgcggcgagcgggcacgcgacgctgccgcgcgcgttctggggctggcacgagatcatcgaggcgaacaggaacggctactggccgtacacgccgaacaccaacctgctgtacgggctcgccgaagcgctcgacatgatcctcggcgaagggctcgacgcggtgttcgcgcgccaccagcggctcgcggaagccacgcgccgcgcggtgcgcgcgtggggcctcgagatccagtgcgcggacccggccgtctacagccccgtgctgaccggcgtgatgatgcccgacggcgtcgacgcggacgccgtgcgcaagctgatctacgaacgcttcgacatgtcgcttgggcaggcgctcggcaagatgcgcggcaagatgttccgcatcggccatctcggcgactgcaacgacctcacgctgatggccacgctcgccggctgcgagatggggctgaagctcgccggcgtgccggttgccgcgagcggcgtcgtcgcggcgatggacaccctcgcatcgaacacgcacgcccccgcgctgcgcgcggcggcctgagcgccggcgggcggcgcgcacgtttcacgcacgccgcccgacgcgccctttccgcttcacgggcggccgcgcgcggtcgtcgcgacacgcaccggccgctgccggcgcccgccccgcttcatcggcacgacccacctcgatgccggcctcgacgccggcacgggcagcaagccagacaacatccaggagacaaaacatgaagctgttccgagcgaccggcatcgtgctggtgatgctgtgcgtgatgtacttcatcacgtacctcgatcgcgtgaacgtgagcacggccgctgccgggttcggcaaggaattcgggctgaacaggacggagatcggcctcgtgttctccgcgttcgcgtatccgtatctcgtattccagatcatcggcggctgggtcagcgaccgcttcggcgcgcgccgcacgctgctcgcctgcgggctgctgtgggccgtcgcgacgctgctcaccgggatggccggcggcctcgcgtcgctgctcgccgcgcgcctgctgctcgggctcggcgaaggcgcgacgttcccggcggccacgtcggcgatgtcgcgctgggtgccgcgcgagaaacgcggcttcgcgcagggcatcacgcatgcgttctcgcgcgtcggcaacgcggtcgcgccggccgccgtcgtcgcggtgatggccgtgtacgggtggcgcgaatcgttctatatctgcggcgtgatcagcatcgtgtgggtcgcggtgtgggcgctcgtctataccgaacacccgaaggaccacccgcgcatcacgcaggccgaactcgacgcgctgccgcaaccgaagccgaaacccgccgccgtgccctggggcccgttgttccgccggatgatgcccgtcacgatcgtgtacttctgctacggctggacgctgtggctgttcctgagctggattccgcagtatttcctgcacagctacgacctcgacctgaagaaatcggcggtgttcgcgtcggcggtgttcttcgcgggcgtgatcggcgacacgctcggcgggatcgtcaccgaccgcatcctcgcgcgcaccggcagcctcaagcgcgcacgcagctggatggtgtcgatctgcatgctgctcacgctgctgtcgctgttgccgctgctgttcacgcatcacctgtacgtgtcgatggcgtgcctcgcggccggcttcttcttcgccgaaatgacgatcggcccgatgtgggccgtgccgatggacatcgcgccggaatactcgggcaccgcgagcgggatgatgaattccggctccgcgctcgcggcgatcctgtcgcccgtgatctccggcttcgtgatcgaccgcttcggcagctgggagctgccgttcatcggcagcatggtgctgatgggcgtgggcgtgctgctcgcgttccgcatgcagccggaaagccgcttcgccgacgcacccgccgaacaaccggccgccaatcgctcgccggcctgatgccaacggggcgctgccgcccgcggcgcccgccttttccccgactgcaacgatgacccaggctacccacgacctcgccgtccggctcgccgccggctggcaacacggcatcgcgttcgccgcgctgccttcggccctcgtccccgccgatgccgacgccgcctatgcggtgcaggcgcaactgctcgccgagcgccgcgccgcgatcggcgcgtggaaggtcggcgcgaaacggcccgacgggccgatccagggcgcgccgctgccggacgactgccgccatgcgagcggcgtcacgctgccgcgcggcgcgttccggccgctcggcctcgaactggagatcgcgttccgcttcggccgcgacttcgcgccgcgggcgcccgcctatgccgacgacgaagtgttcgacggtatcgcgcagatgggcgccgcgatcgagatcgtcgcgagccgcttccgcgaatggccggacgtcgcgcctgccgcccagctcgccgacctgcagaaccacggtgcgctcgtgctgggcgagatgaccggctatcgcgccgatttcccgttcgccgcgccggccccggcgttcacgttcgacgggcacgacatcgccggcacagcacctggcaccaacccggccggcgacccgcgccgcctgctgccgtggctcgtgaatcacgcgtcgcggcgcggcatcgcgctgccggccggcaccgtcgtcacgaccggctcgtacacgggcatgtattttccgcaggccgcgggcacggccgtcggccgcatcgcggggctgccgcccgtcagcgtcacgctcgcctgatccctcacccgatcctcgcccgatccgttcccacccgataccgaccgccgccatgacatccgccgtctcgccttcgctggttcgccccgtccatctcgtgccgtcgcaaggcgccgcgctgtcgccgctgttcgagcggctgcgccgtgaaatgcgcggcgacgtctacgccgatcgcgcgagccgcggtcgttatgcgaccgacgcgtcgatctaccagatcatgccgctcggcgtggtcgtgccgcgcgaccaggacgacctgcggatcgcgctcgacatcgcgcgcgaccgcaagattcccgtgctcgcgcgcggcgccggcaccagccagtgcgggcagacggtcggcgaggcgctcgtcgtcgacaccagcaaatggctgaaccggatcgtcgcattcgatgcgcaggcacgcaccgtcaccgtcgagcccggcatcgtgctcgaccacctgaacgcgtggctgaaaccgcacgggctgtggtttccggtcgacgtgtcgacggccgcgcaatgcacgattggcgggatggccggcaacaactcgtgcgggtcgcgctcgatcgagtacggcaacatggtgcacaacgtgctcgcgatcgacgcgatcctcgccgacggcagcgaatgccggttcgggtcgctcgcgcaggccgtcaccgatcgccgcacgctcgagctgctgcacggcgtcgaacgcatcgcgaagcgcgagcgcgacgagatcgttgagcgcgtgccgaaagtgctgcgccgcgtggccggctacaacctcgacctgttcgactgccagaacccgcgcgcttacaccgacgacggtcacgcgaatctcgcgcacctgctcgtcggctcggaaggcacgctcgcccatagccggcagatcacgctgaagctcgcgccgctgcccgcgcacaagacgctcggtgtcgtgaacttcccgaccttctaccaggcgatggacaccgcgcagcacatcgtgaagctgaagccggtggccgtcgagctggtcgatcgcacgatgatcgacctgtcgatggaaaacccggcgttccggcccgtgatcgaacgggcgctggtcggccagccgcaggcgatcctgctcgtcgagttcgcgggcgaatcgcgcgacgcgcaacacgcgcagctcgaccggctcgccgaactgatggccgatctcggcctgcccggcagcgtcgtgaagatgaccgatgccggcgcgcagaaggcgctgtgggaggtgcgcaaggccgggctgaacatcatgatgagcatgaagggcgacggcaagccggtgtcgttcatcgaggattgcgcggtgccgctcgaacatctcgccgaatacacgcgccgcctgaccgacgtgttccacaagcatgagaccgaaggcacgtggtacgcgcatgcgagcgtcggcacgctgcacgtgcggccgatcctcgacatgcggcgcgacggcgcgacgcgcatgcgcgagatcgccgaagaggcggcggcactcgtgcgcgagtacaagggcgcgtattcgggtgaacacggcgacgggctgtgccgcggcgaatgggtcgcgtggcagtacggcccgcgcctgaatgcggcgttcgcggagatcaaggcgctgttcgatcccgacaaccgcttcaacccggacaagatcgtcaatccgccgaagatggatgcgcgcgagcatttccgtttcgcgcccggctatgcggcgctgccgctgcggcccgcgctcgactggtcggcctggaacgtcacgcgcaatccgctgaccggcgaagaaaccgcccccggctcgggcaccgacatcacgcacgggctcgcgtcggccgtcgagatgtgcaacaacaacggccactgccgcaagttcgacgcgggcacgatgtgcccgagctaccgcgtgacgcgcgacgaacagcacgtgacgcgcggccgtgcgaacacgctgcggctcgcggtgacgggccagctcggcgccgacggcctcgccggcgacgacgtgaaggccgcgctcgacctgtgcgtgtcgtgcaagggctgcaaacgcgactgtccgacgggcgtcgacatggcgcgcttcaagatcgaggcgcggcacgcgtggaaccgcaagcacggcacgacgctgcgtgaacggctcgtcgcatatctgccgcgttatgcgccgtgggccgcgcgcatgcgcggtgcgatcgcgttcgtcgatcgcgtgccggtcgtcgcgtcgtcgatcaagcgatggatcggcctcgcgccgcagcgtgcgctgcccgggttcgcgcggccgtttctggcggatgtgggtgcggatacggggacatcaacgccctcgcaaaccggctcggccacccgcgaagtgctgctgttcgtcgataccttcagcaactaccaggaaccggacaacgcgcgcgccgcgcaggccgtgctcgaagcggccggctacaccgtgcatttcaacgtgcgcgcaggcgcgcggccactgtgctgcggccgcacgttcctcgcggccgggctcgtcgacgaagcgaaatccgaggccaggcgcacgctcgatgcgctgcggccgtacctcgaacgcggtgtcgcgatcgtcgggctggagccttcgtgcctgctgtcgatgcgcgacgagtttcttgcctacggttacggcgacgaagccacacggctcgcgagccacgcgttcctgttcgaggagtttctcgtgcgcgaacacgaggccggccggttgtcgctgccgctccactcaatcgatgcgaacgaagcgctcgtgcacggccactgccatcagaaggcgttcggcgcgttcacgccggtgcagacggtactgcgctggattccggggctgaaggtatcgccggtcgaatcgtcgtgctgcgggatggccggcagcttcggctatgaagccgagcattacgccgcatcgcaggccatggccgagctgtcgctgctgccggccgtgcgtgcgcgggccgaaggcgcgatcgtcgtcgcggacggcacgagttgccggcatcagattcaggacggcgcgcaagcgcaggccgtgcatgtggcgaaggtgctggcgcgggcattgcgaagctgaccgccgccgcgtgcgcctcacctcggttcgccgatcccgcccatcagcgtcaccagttgctcgcgcagccaccggctgccctgatcctgatccgcgctgcgatgccagtagcagaagtattcgagcgccggcatctcgaacggcagttcgagaatccgcgccggataccgctgcagcagccgcagcggagccgtcagcgccaggtcgccgcgcatcgcgatcagcggcgcgaccatgtagtgctgcacgcgcatctggatggtgcggcgcaacccgaggcgcgtcagctccgcgtcgacgtgcccgctgcccttgcggcggctcgacacgtggatgtgccccatcgacaggtagtcgtccatggtgagcgtgtcgcccttgaacgggtgatcgtcgcggatcatgcacgcatagcggtcgcgcacgagcagcgcctgatgcaggtgcggatcgccgatcagcggcgcgtcgatcgcgatgtcgacggaaccgttcgcgagcgcggtcgcgacttcgcggcggtccatcgtgtagctgcgcacgtgcatgccgggcgcatgcttctgcagcagttcgccgagcgcgggcagcagcagcgcttcggtcaggtcgctcatgctcatccggaacacgcgcgtcgacgacgccggatcgaacacgtcgccttcgtgcgcgctcgaatcgagcagctgcatcgcctcgcgcacacggccgacgatgttctcggccagcggcgtcggcatcatcccggccggcgtgctgacgaacagcggatcgttcagggtcttgcgcagccgcgccagcgcgttgctgacggccggctgcgtgagattcagcacctcggccgcgcgcgtcaggttgcgcttggtgtagatcgcgtcgaatacgacgaacaggttcaggtcaatcttcgaaaggcgcatcgccggatctccttgccggcatcttacggcgtgcgccacccgctcgtccacggccctgcgcatcccggcgcgacgctcaggcgcgcagcggcggcgtcaggtacggcgccgtcgaacccggcacgccgtccttgatttccatccgcgcgatcgcctgcaggtgcacctcgtccgggccgtcggcgaagcgcagcgcgcggccccaggtccacaggtcggcgagcggcgtatcggggctcaaccccgccgcgccgaacacctgcatcgcgcggtcgcagacgttcgcgtatacggtcggcaccagcgccttgatcatcgcgatttccttgcgcgcggccttcgcgccgaccttgtcgatcatccacgcggccttcagcacgagcaggcgcgcctgctcgatctcgatgcgcgagcgcgcgatccattcgccgaccgtgccgtgccggttcagcggcttgccgaacgcgacgcgcgactgcgcgcggtcgaccatcagctccagcgcgagatcggccgcgccgatcgaccgcatgcagtggtggatgcggcccggcccgaggcgggcctgcgcgagcgcgaagccgctgccttcctcaccgagcaggttgctcgccggcacgcgcacgttgtcgaacgtgatctcgcaatgcccttccggcgcgtagtgattgaccaccgtgatgttgcgcacgaccgtcacgcccggcgtgtcgcgcggcacgagaatcatgctctgctgccggtgcgactcggcctcgggatcggtcttgcccatcacgatgaagatcttgcagttcggatgcgcggcgttcgtgatgaaccacttgcggccgttgatcacgtactcgtcgcccacgcgctcgatgcgcgtcgtgatgttcgtcgcatccgacgatgcgacatcgggctccgtcatcgcgaacgccgaacggatctcgccgcgcagcagcggcttcagccactgctcgcgctgcccgggcgtcgcgaacatgtgcagcagctccatgttgccggtgtccggcgcgttgcagttgaacacttccgacgcccagcccacgcgccccatgatctcggcgagcggtgcgtattcgaggttcgtcaggcccgtgccgggctcgtcgtccttcaggtgcggcaggaacaggttccacagcccttccgccttcgcgcgctccttcagttcctccatgaacgacacgggatactggcccgcgtgcacttcctcgttccactggcggatgcgcggcacgatgtgtgcatccatgaatgcgcgcacgcggctgcgcagttcttccactttcggggtgtagccaaagtccatgatcgactcctcgattccgttcgttcggttccgtcagaaggccgagacaccgccgtcgacggcgacggcctgcccggtcagataagtgttttccttcgagcacagcgtcagcatcgtcgcgacgatttcctcgggccggccgagccgcttcatcggcgagccctgcgcgagaaaatcctggcggtcgccgatatcgctgtcggtgaccatcggcgtcgtgctgtagaacgggcacaccgcattcacgcgaatgccgtggcgcgcgtattcgatggccgccgtcttcgtgagcccgaccaccgcatgcttcgacgccgcgtaggcggccagcttcggcgcgccgccgagcccggccatcgacgcgacgttcaggatcacgccttcgcgctgcgcgagcatctggcggatctggtgcttcatcccgaagaacacgcccttcgcgttcaccgcgaagctcaggtcgagatcggcttcgtcggtgtcgatcagcgccttcatcggcggcgcgatgcccgcgttgttgatgcccacgtcgagccggccgaaacgctcggccgccgcatgcaccagcgcggcgacgtccgcttcggcacgcacgtcgcagcgccgcgcgatcacgtcggcgccggccgcgcgcagcggcgcggccacgcgttcgagcgcctcgccgttcaggtcgccgagcgccagccgcgcgcccatcgcggcgagctcgctcgcgagcaacgcgccgaagccgctcgcggcgccggtgatcatcacggcctggccggcgtagctgtcgatcttcatcgcgcgctcagatcgtcaggccgccgtcgacgacgatgcattcgccgttcgtgtagctcgccgcgtccgacacgaggtacagcacggtgccggccatttcgcgcggttccgcgtggcggcgcagcggaatcttcgccttccaggtctcgtagatgtccttgtcggcgaacagcgcgcccgcgaacttcgtcttcgtgagccccggcagcagcgcgttcacgcggatgccgaacggcccgcattccttcgcgaacgccttcgtcatgttgacgacggccgccttcgtgatcgagtagatgccctgccggtcgcccggctgcagcgcattcaccgacgccgtgttgacgatcgcgccgccgccgtgttccttcatcagcttgccggcctcgaccgacatgaagaagtagccgcggatgttcacgtcgaccgtcttgtcgtaagcggcgagatcggtatcgaggatgtgcccgaaatacgggttcgcggccgcgttgttcacgaggatgtcgagccgcccgtgcttgccgcggatatgctcgaacgtcgcggcgatgtcttccaggcgcccgacgtggcaggccagcgcctcggcgcggccgcccgccgcgacgatcgcgtcggccacggcctggcagtcgtcgagcttgcggctcgacacgatcacgtgcgcgccctgctccgcgagcagtttcgcgatttcctcgccgatgccgcggctcgcgcccgtcaccagtgcgatcttgcccgtcaggtcgaacagattcgttgccatgttgctgtgctcctccattgatgtggtgtcgtgcccggcgcggtcagcgctgcgcgtcgatcacgccgacggccatctcggcgagacgcccggccatcgcgccgacgcgcagcgcctgctcgctcgatgcgttgccctgcagcgcgcgcgccttcacgccctgcgcgatcgccgcgagccggaagaaactgaatgcgaggtagaaatgccagtcgcggatcggctcgatgccgcgcagctcgcaataacgcgcaacgatcgccgcttcgtcgggaatgccgagttccgcgcgatcctggcccgcgagcccgcgtacctgcccgcccgacggcagtcgcaggcacatgcagaagtacgcgagatcggcgagcgggttgccgagcgtcgacagttcccagtcgagcaccgcctgcacgcgatagctgtcgcgcgcgaacatcaggttgtcgatccggaaatcgccatgcaccagcgtcggccggcccgtgtcctccgggcacgccttcggcagccagtcgatcagcgtttccatcgcgtcgaggcgctccgtttccgccgcgcggtactgcttcgtccagacgccgatctggcgctcgaagtagttgccggggcggccgtagtcggcgaggcccaccgcgtcgacatcgacgtcgtgcaacgcggccatcgtctgcaacaaggcgtcgtagcacaccgcgcgatcggccttcggcagctccggcagcgcgggatcccagaagatccggccgtcctcgaagctcatcacgtagaacaggctgccgatcacgtcgcggtcttcgcagaggtgatacggatgcgcgaccggcaccgcagtgcccgacagcgcgctcagcacgcggaattcgcggtcgaccgcgtgcgcggatttcagcagttcgcccggcggctggcggcgcagcacgtagcggccgctcttcgcatgcagcaggaaagtcggattcgactggccgccggcaaacttctccgtgtcgaccgggccttcgaaacccggcacgtgcgcttccagatagcgcgtgaggcgggctacgtcgagttgctgggtagggttcgtcatcgtcgcgatcgttcgtgggtcagccgtaggttcgcagcgcgtgtcgttcgggatcctccagatgcgggatgccgttgaacgacgcgaggtggaatgcatcggcgttgaagaaaaactgcgaaaggctgctgttgcggatctgcaggttcagcgcgatcgcgctcgacggcggggcggccagcacctgctgcacggtgaccgcgatcgggccgccggagctcaccgtcagcacgcgctggccgccgccgtggcggatggccgcgcgggcatcggccacgcgctgctggaagtgcgcccaggtctcgggggccgaatcgccgagcttgtcttccgaccagagctgcagcacctgccgcagcgcgcggaaatgctccttcatcgagccggccgcgaggcgggcgatgtccgggtagtcgtgcgcggcggcggcaaacaggccgtggaagtcgtattcgttcaggccgggatggcggtcgatcgccgcgccctcgcggcccatcccgcgcaggatcgcgtcgaccgtctgcgcgtggcggttcatcgtgccgcagatcacgcgatcgaacgccaggccttgctgcgcaaagtattcgccgagccagacgccctgctgctcgcccgccgggaaagccggtcgtagtcgtccgtgccgaaggacgcctgcccgtgccgtaccagaaaaagttcagccatcgcatgcccgccagatcagaaggattcagcataggggcggggatgcattttcaaactttattttctgaatcggcgggtattcatcgggtgaatttcaggcatgccaaccgtgcgcttgcgccggctttcgcccgccctcgccgcggcacacgaattgcggcgggaggcaccgtccattcacgacgtcgggagggtgcgatgctcggtacgatcctcatcatcattctgattctgctgctcatcggggcatttccggcgtggccgcacagccgaagctggggctactggccgtcgggctcggtcgggttgatcgtcgtcatcgtcgtgatactcgtgctgctgggtcacatctgagtccagcgacgcgtgccggaccggcacgcgtcgccggatgccggcgccgtagcttctttacaaacgcaggcaagggcgggacatccgtcggccaggcgcgaatcgcgccgcgctgcccccgcctccgttcgattgcgccggccgtgcggtagtatggcgacctgacggaacccctgatggatctgaacgagtggccatgcccgaattttcttcatcgcccggcgccggccagaatgcccaggcgctcgtcctcatcgccgaagacgaacccgagatcgccgagatcctgaccgcctatctcgcgcgcggcggcctgcgcaccgtacacgccgccgacggccgccgcgcactggagctgcacctgcagctcaagcccgacctcgtgctgctcgacgtgcagatgccgcacgtcgacggctggaaggtgctcgccgaaatccgtcatcgcggcgacacgcccgtcatcatgctgaccgcgctcgaccaggacatcgacaagctcaccggcctgcgcatcggcgccgacgactacgtggtgaagccgttcaatcccgccgaagtcgtggcgcgcgcgcaggcggtgctgcgccgctcgatggccggcgcgcgccaggaagaacagcgcgtgctgcgggtcgcgccgttcgagatcgatctcgaacaccacgaagccacgctcgaagtgggcagcgaacggcacacgctcgtcctgacgctcaccgaattcaagctgctcgcgcaactcgcgcgcgcgccgcggcgcgtgttcagccgcgccgagctgatggccacctgcctgccggaaggcgacgcgctggagcgcacggtggacagccacgtcagcaagctgcgcaagaagctggacgacctcggcgtgcagggcgtgccggtcagcgtgcgcggcgtcggctacaagctctggagctgagcatgaagctcgacggcctgagccggcagatcgcgctgaccatggcaggcatggtgttcggcgtgaccgtgctgatggtgctcactgccaccgtcttctactacatcgcgttcaattactggccagcgcatttcaacacgaagaacctgctgccgaccgggccggaatgggcctggctgatcgcgaccacggcggtcggcctcgcgctgtcggtcgcggtcgcggtcaatctcgcgcgccgcatcctcgtgccgctcaattcggtcaccgaaagcattcgccgcgtcgcgcgcggcgatctcgacgcacgcgccgtcgcgggcgaccgttcactgcacgaagccgcgctgctcgccgacaacttcaacgcgctcgccagcgagctgcagcgcgtgaccaacgagcaggcgctctggaacgcggcgatcgcgcacgagctgcgcacgcccgtcacggtgctgcgcgggcgcctgcaggctcgccgaaggcgtgttcaccccgacgaagcgcagttccgcagcctgctcgggcaagtcgaagggctgacgcggctgatcgaggatctgcgcgtggtcagcctcgcggacagcggccacctgagcatcgagatccgcgacaccgatctcgcggcggatgcgcgtgcggtggtcgacatgttcgagccggcgctgcgggccgccggccagcatccggtgctcgatctcgacacgcggcgcatgcgttgcgacccggtacgcatccgccaggcgctgctggcgctgctggaaaacgcgcggcgccatgcggtgcccggcgcgatccgcatccagacgcgcatcgaacaagggatgtgccggttgcgcgtcggggacgacggccccggcatcccggcggatttcgcgccgcacgtgttcaaggccttccggcgcgccgacgacacgcagccgggcggcagcggcctcgggctcgccgtcgtcgcggcgatcgcccatgcgcatcatggcgaagctgtctgcatgccgagccgcacgggcggcacgctgttcgaagtgcagtggcccgacaacctcacgccggcgccggaacacgcgcgctttccggcctgaggcatcgcctttacggccgacctggcgcccgcctttaccgcgccacgtgcggttcgcgcccgacctgttcgagcggcgggttgaacccgagcaccgtgtactccagcacggacaccgtccctttcccggccgcgccctgcacgacgaccgcgcgcaccgcgccggcccggtcgaatttcaggcgggtgccgacggtcgcgttgcgcagcgcctccagttcctcaatccgcgcgatcgccagcttgcgcaccgcaccggacacgtacaccggcaggaacaccagcgcgatgaagatcgacacggcatccttcgatacgctgtccagcaccggctgacccgacatcacgagcgacagcgacgtcgcggcgacgaagatcgcgagcacggtcgcgcccacgccgagcgacgagaaccgctcggccgccttcttcatgcgtgccttcacgagcgcgcgcgtggtcgcggacggcaccagccattcgcgctgcgcgccatggtatccggcgaaaccgaggaacagcgtcgcgaccgcgctgatgccgatgctggtgtacagcgcatcgaagatcatgcagaggaattcgagcacgaacacgatcaccggcggccacagcagcagccggaacgaatagccgtcgcggccgtgcccgcgaatccaccatttcaccggcgcaagctgccagaagcggctctcctggtgcagcgaaagttcttcgttgtcggtcaatttcccacctgtcgaatcctgcgccgtgtcggcgccggccgtgaatcggcccggccgcattctcccagatgcgcggcgcggcgaaaggccgccgccggcctccgatttccggccgacaccttgtgtgcatcgcacatgcacgctcgcttgacccggcccttgggatcgcctttatgctgagctcaacgaatcgacagcaaggagaggtgacggatgagcacgtccacgccccgtttgaacgcgtcggccgccgccgcggctcggcgtctcgatcaaggcgctgcggctgtacgagcggcacggcctcgtcacgccggaacgcacgccggccggataccgtgcgtacggcccggacgatctcgcccgcgcggccgacatcgccgcgctacgcgcactcggcctcggtctcgcgcaggtggcgagcgtgctcgacggcgacgcgcgcagcctcgacgacgcactggccgctcacgaagcggcgctggatcacggcattcaggatctcgtgcgcaaggtcgatcgcgtacgcgcaatccgcgccggcctcgcgcgcggccggatgccggctgccggcgaactgacccggctcgtcgacgacagcagcgccggcgtggcattcagcctgccgtggccgtggggcggcgagtggttcgagtgtcgcgacatccggccgctgaactacatcatcggcccgctcggcagcggcaagacgcggctggcgctccggctcgccgacgcgctgcccggcgccgcgttcgtcggcctcgaccggctggaacacgacggtgcggcggcacgcgacgtgctgcgcaccgatcctgcgttgaagtcgcgcgtcgaccgtgcatcggcagcgctcgctgcccgaggcgcaacgccgtcggcggcgctgaccgcgctgctcgtcgccctcgaagccgaaggcccgcgcacacgggtcgtcgacatgatcgaacaggatctcgatcgccccacgcaacaggcactgattgcccgtctgcgcgaacaggccgccgccgggatgcggccgctgttcctgctgacgcgttcgtcggcgatcctcgacctgtcggcggtcggcccgcacgaagcgatcatcctgtgcccggccaatcacagtccgccttcgcgtgtggcgccttaccccggctcacccggctacgaagcggttgccacgtgtcttgcgtcgcccgagatccgggcgcggatcgcgcatccccggaagcggcgtaagcgttcgtcacggcgccatccgccccatcctgcgcgccatcgccgggctgaccgcatgcaccggatcgaacccgaagaattcgagcacgtggcgcgcgacgtcgtcgcgatcgttgtccgcgcagatcatgtggtagctgttctccagcacgatcccgcgcgcgtcgggcatcttcgcgagcaggaaatcggccgagcgcaggctcgtcagctcgtcctcgcgcgcatgcagcacgagcgtcgcgcacggcgtgccggctgccgcctcgagcgcccagtcgcgcatccggtcgacttggcgcacgcacgcgagcggcacccacgcatagtggaaactgtcctcgcgctcgaacttcttcttcacgatcgcgcggatcgtcgcgttcttgatgccgaacggatcgccttcctcgacgcgcatccgctccgcgacacccggcacgcgatacagcacatgccgcaacgcccggtaccacggcgtcgaccagccgtcgatgaacaccggcgtggccagcagcgcgagccggccgcgcgcatgctgcacgcgatggcacagcagcagcgcgaccagcgcgcccatgcacatgcccgcgacatgcacggtgtcgtactcgttctccagcgcgcgatactgctcggtcaccgcgtcgagccatgcctccgcgcgcacgccgaccagatcctcggggcgcgtgccgtgccccggcagcgtgatcatgtgcgtatcgccgcccgcgcgccgcaccgccttgtgcagcgaaccgagatcgtattgcgtgccgccgagcccgtggatcagcaggacgcccgtgcgccccgtcatgacgcgtccccgctcattcgtccgccggccacacgcgctcgagctgccagacgcctgccaccaccgtcacgtcgacattcgagtcgagcaacggtgcgccgtgatcggtgatcgtctgcgtgccgccgtcgcgctgcacgatacgcagcgacagcgacgcacgatcctcgccggcgatctccgcgttccagtagtcgctcaacgcatcgcggtcgcccggctgcacacgttcgagcacgagcgacacgctcgcgatctgcgccgcgtcgacgccgacaccgaacacgcgctcgacgtcgccgctccactcgatccgccccgattccggatcgagcacgtacgcgatctggccggcgctcgcgagcgcgagctccatgttgttctgcaggaccgccgcatgctcgtgcacgcgctcgcgcgtcgtcttcagcgtgctcaccgtcagcaccagcagcgacgcgaccgccaggtaaagctgcgcctcgagcagcgaactgccgtagtgctcatggaacgacgcgaacgggccgtcgccctgcgcggtctgctcgatcacgatcagcgcgagcaccagcaccgacgacgaacccgcgcggccgccgagcagcagcgtcaccgcgacggtcaggaacagcgggatgtacgtcagcgcaaagccggcgcccgtgccgaatttcttcgacgtgtcgccgtcgaagatcacgagtgcgccgatcacgagcagcgcgaacgcgacgatgccgagtaccaggtcgaagcgctcgtggtcgcccgagcggtgcgcgcgaaagcgcgaccatgacgcgagcaccggcgtgaccagcagcacgccgacgaaatcggacgcggcccacaccgaccacacgtcgaggaacggcgcgcccttgaccgccgtgtaccacgccgcgccgccgatcgcgccgatcacgcccgcgatcaggccggcgaggatcaccgagcgcaggaaatacagcccttcgagcgagaaacgcacgcgctggacgagccacaccgcgagcgcggcggcgccgacctcgtcgaccgtgaacagcaccgcgttgaccagactgccgtgttcgatgccggtcagcacgagttgcccggccaggaacgcgccggccagcgtcagccattcgcgcatcggccgcagcatgaacgcgccgaccgtcacgccggccggcagccagatgtagcccgtcagccggacggggccgttgaactcgtgcgagatatagccggtcgcgagatacagcgccgcccagagcagcgcggcgacgaggcccggccgcgatcgtttggtgtccatcgagaatccctgtgtgctgcgccgtgcaggcagacgcaccgccgcgtcggaagcggcggcgcctgcggccggcaggtgcgcgatgtgcgcatgatatgcggacagggctgacggaggaataccggtggggaggcacgggaagccgcggcctccgatccggctcgccgggccggcggaaacggcgtgtggcgccggctacccgacgcgtgccggaacggccgcgatcacggcctcacggccgcatgcgtcacgtatcgaacggcctcccggttcagtcctttcgccgccacaccgagatcggaatgtccccgttggcacgcggcggaacgcggtagctcagctcgccgtccttcaattgataggtgcgcgtctgcgtttgcccggcccagttcgggtacgacgcattgctgatgtgaaacgccagcgtgtggttcgcgggatcgacgctcagcgtaccgtagtgggtactcgagccgagcacggcgtcacggaattcctccggcgtgccggtcgccttgtcgttcgacgcgaagcgcgggcgttccgacttgaagatctgcagcgagtagttcccgtgcgcgtcgatcagcagcaggcccgtcggatcggcaccgtagtcgcggccgatcgtgccgtcgggatgttgtacgtccgccgcgaccagcgtccacgtccccgcgagcgacggcgcggccgatgcgtcaccgggaatcatcgacgcggccagcagcatgccgggaaagccttggcggaatatcgagccgattttcattcaatgtccttgtcggaaagaagggaagcaacctcaccctcacggacatccgcagccgcgtatcgcgcgcatccccgtgaaccgaaacgaccggttcacttgatggtagcgacgggaatatgcaataaatacgataattcgaaatcgacttataagaaaaaccgaatcatgacgcttccgaatctcgacatggatgcgctgcgcacgctgattgccgcggatcggctcggcagcctcaaccgcgccgccgaccggatcggccgctcgcagtcggcggtcagccagcagatgcgcaagctcgaaacgcagatcggccagccgctgtttcgccgccagggcgcggcctcgtgccgaccgaagccggcgagctgatgctgtcctatgcgcgccgcatcctcgaactgaacgacgaggcggtcggcgcgatccgcggcgcggcgatcgacggcgccgtgcgattcgggctgcccggcgatttcgccgaagcgtggctgcccgtcgcgctcggccggttcaagcgcacgcatccgggcgtgcgcgtcgacatcgtcgtcgacggcaacggcgcgttgctcgaccggctcgatggcggcgaactcgacatcgtggtcgcgatggggcgcgggcatcgcgccgacgccgaacacctggtcacgctgccgatggcgtggatcgggccgcaaggcatcgacgtgcgtccgcgtgccggcgcaccgctcgatcttgcgctgtacaagccgccgtgcctgttccgcaaggcgggtaccgacgcgctcgacaaggccggcatcccgtggcggctcgcgtacacgaccggcagcctgcaaagcctgtgggccggcgtcgccggcggcctgggcattacatcgagaacgatggcgggtgtgccgccggcgctgcggcagctcggcgagcgcgacggcctgccgccgctgccgtccgtcgacgtgtgccttcatgcgggcggaggcgacgcgccttcggcgctcgtgagcctgaagcgcgtcgtgatcgacacgctgatcgccaatctcgccgatgtgcacccgcactcgggccggcgcgccggatgatcggccacgcatgcgcgccgggctcggcgttgcgtcctttgaccggcttcccgccatcgcggatgatgcgctgcggggttcgaccttcccgtcggcgctccgtcccgaacgaacgtacgagtccgcacgatgacacacgcaatccgcctgcgcccggcatgcgccgccgacctgccgttcctgctgaccctgcgtcggctcacgatgaccgtgcacctgcagcgcgtcggcgcgccaaccgacgacgaagcgcacgaccgtcgcattcgcgcgaacttcgacgatgcgatgatcgtctgcgacgccgacgacgcaatcggcttgctgaaggtgacacgcgccgccgacgagtggcacgttcaccagatccagatcctccccgatcatcagggccggggcatcggcgaagccgtgctgaacgcattgctggccgacgcggcgcgcgcgcacgtgccggtatcgctcagcgtgctgcacggcaacccggcgcggcggctctacgaacggctcggctttcgcgtcgcgtcggcaaccgacacgagcgcgagcatgatctggcgcgcgtgacgcccggcgtttcgacgccgccgcattactgcgtgatcttcgcgtccttcagcaggttgccgatcatctgcgcgctcgccttctccacggcggccgcctgcaattgctgctgcagcgccggcttcgcggtcgcgaaacccggcacctgcgtcggccgcttcgcatccagcttcacgatcgcccgcacgccgtcgaccgggatcgaatccttcgtcgcggcgccgaccgtcagtttctcgagcgcctgcgcgaccggcagcggcaagccggacgtcttgccttccgccgccggcgtgtggaagctcacccacggcaactcgccgccgctgtcgcggctcggcgcgatgctgtactggcgcgccagcccgtcgaacgacttgcccgccttcagttcgctcagcactgtcgcggccgtcaccggatcctggacgatgatcaggcgcggcttgtactcgttcttgccgagcgacgccacgagctcgtcgtagcgcgccttgacctgctcgtcggtcaccggctcgggcttcacgttgtcgcgcaggtaaagctgcacttcggcattcgccttcgcctgctgcaccgccgccttgacctcgggcttgtcggcgtagttcgccttctcggcggcctgctggaccagcacgcgcgtaatcagctgattcttgatcgcctggcggacctgcggcgagtcgggttgcccggacgcgcgcagcaacgtgtcgacgtcggcctgcgtgatcggcgtgccgttgaccgtcgcaacggtcgcggcggccgccggcgtctctgcgtggactgggccgctcatcgcgccggccagtgcggcgatcagaaacaggcggttcggtgtcgttttcatcttcattgtttcgtcacttcggcataaaaacgcggcatggggcatgccgcgcgagttcaccggcgctgcaatgcgccggcgcaacccgtcagtcgatccggttcatcgtcgtgggcacgcgcagtgcctgccggtgccgctgtcattgtgcccggaaccgcttttccgcgtcgtgaggtttggaacggccgcccggcgggcggtgaggcgcgcgttgcgcacgccgctcattacgaacgcgcgatgtggaaattgcgtggatacgcggtggaaatcccgcgaaatcgcgacgaatacggtgaggcgttcgcgagcccggccgccggtcgaggcggccgcgcgttcatcaaggcgtccaccggtacacggtgatgctgttgcctttcacgttgttcttcatcaccacgtactcgccgttcgtgcggcggtatgcgcgaatgctgtacatcgcatcgatcgcgctgctggtatccacggtcgcggggctcgcgttgaccagcgtcgtgtcgagagtgccggtcgtcaggttgaacgcgtcgacgttcggccacagcggcccgctgctgctgaaccagtagccgacgaacagatggttgcccaccgcgtcgatcgatttcgcgccgctgtgcggcagcgtgatcaccgggtccggcttcgtcgtattgcccgcgctccagccgtgatacacctcgatgcgcgtgccgatcgacgtccagtcgttggtcccgatcgcgccttgcgcgagcaccatcgtgtcgctgtccgcgagatagacgatgcgcgtgagcggctggatgctgtcgggcacgcgggtcgcgacacccggcccccgacggcttgccgctcgcgtcgaagccggtcagcgggtagtgggtaatcgcgccggtcttgtcgagaccggcccacacgccgcccttgctgtcgacgctgaagccgcccgtcacgcgccgcgtcgtgttgaacgcggggcccgggatcgcgccgtccggaatcgcgacatagccgttcgccgcgttgaagtggaagaagtagaagaccggcgggttctggccggccgcgacgagaatccggttcgcgcccaccgacgtgagcagaccgaaatgctcgtcgcgctgcgtgtcgttcatgtcgatgcgcggatcggccgggtacgtgaacggatcgaccgtgttcgcgatgaacctgccgcccgcgctgccgccgtacacgtgcgtgccaccgtagaacagcgcaccgtccgtgaccgggtccggcgcggcgatgccttcgaagttcagcgactgcagcgtccaccgcaggctgccggtgctgctgtacgcatgaatgtcggtcgcgccgttgcggccgagatcccagccgccccatggattgttgagcacgtagagattgccgccggtgtccttgccgatcccgacgatgcgcgtgaagcgctgcgcgccgacctgccccttgatgcccgtcgtcgtgtcgagatagccgccgcgcacgccgaaagtgccggccagcgcgggccggcccgacaccgtatagcgcttgatgttctggtccgggccttcgtcacccaccagcagctgcccggccgccgcatcgaaatacagcgccgacggctgcgacccggacggcatccggatcgtgttcagcagcgcaccggccgggctgaagccgacgatcgagcctgcgcgcttctgcgccacccacacgttgcccgctgcgtccagcgcgagcgcgcccggctccgatacgccgatatcccgctgccacacgccgtcggtggtgaacacgcgcacgcgattgccgtagaagtcgcttgcataaagcagcgagccggccgtcgcgagcccggtgacgacgtcgatgcgcggctggttggtggccgcgctgacctggattacgcgatcgcgatacttcgtcgcgcggttgtagcgccccaccgcgccgctgccgtatgtcttgccgggctgcagcgcgacgaacagcgaggtcgcgttgcccgtgatcgcgctgccctggaactccgaatgcgtgccgatcgagccgacgctcttgccgttctggtaaatcgcgacaccgccttcgtcctcgtcccacatcgacgccgtatagatcacgccttcaggcgcaacccacatcgcacgcgcgacgttgccgacgtgggccgcgagcgtgccgtacgtgttcgccagccagtcggtggtgttgcgtgcgtgaacgggcggggtaatcgcggcgatcgccgcggcgagcagcgcggcctggaaccgttgtctggcgaccatgacggatgcactcctgaatggtgcgaacactcatatgaagggccggccggatggcttgaaagccgcaatacgtcaattcttccgctgaagcatccggcgcagtcggtattacgtacggcatgcgttcgatcatgcgcagcgcgagaatagcgttatataaatcaaaaaaattgcggatcgcgcgcgtcattgcgcttttcgcgggaacggcttcgacggcatcgcccgtggcgcccctgcgcgccggcggcaagcgtgaccgcgcgacagtgaatggtcacttgcgcatcgaatcgggaatcgggaaattcaggctcgtacctgagggaatatcgccgccggttcagcgacgatcgattgaaacggcgagtgcctgtttcggagaatcgggaaaaagtcacggcattcaatgcggattcattgcacccgacaaatcgccggcctgaatccattgcgaatccaggccggcgatcatccgttaccgcggggcaggcaacgcgccactaacgccgcactgctgcactgccgcaccgccacgcatcaagccgatgccgaggtctccggcaccttcaccttcatgacgcgtccgttatccggatcgttgtcgtcgcgcggagcgtcgagctgcccttcccacttcgcgaccacggcagccgcgatcgagttgccgacggcgttggtggccgagcgccccatgtcgaggaacatgtcgacgcccatgatcagcagcaacccggcttcgggcatgttgaactggttgagcgtcgcagcgatcacgaccagcgacgcgcgcggcacgcccgccatccccttcgacgtgaccatcagcatcagcagcatcgtgatctgcgtgcccagcggcagatggatgccgtacacctgcgcgatgaacagcaccgcgaacgtgcagtacatcatcgagccgtcgaggttgaacgaatagccgatcggcagcacgaagctcgagatcttgcggttcacgccgaagcggtcgagcgcatccagcagcttcggataggcggcctcggaactcgccgtcgcgaacgacagcaggaacggctcgcggatcagccggatcagcgtgaacgcgcgcttgccgaggaacgtcacgccggcgagcgtcagcacgccccacagcagcgccagtgccaggtagaagctcgccatgaacttcgcgaacgtgagcaggatgccgagcccctgggtggtgatcgtcgacgccagcgccgcgaacaccgcgaccggcgcgaaccacatcacggcgcccgtgaccttcagcatcacctgcgcgagatcgtcgatcacgccggtcaggcgcttgcccgattcgccgagcgccgacagcgcggtgccgaagaagatcgagaagatgacgatctgcaggatttcgttgttcgccatcgcttccgcgatcgacttcggcaccaggtggaccacgaaatccttcagcgtgaaggcgcccgtcttcaggttgagggctgcatcggatgccggcagcggcaggctcaggtggctgcccggctgcaggatcgttgcggtcagcaggccgagcagcaacgacgtaaacgaagcgatgaagaaccagccgaacgccttgacgccgacacggcctaccgcgctgccgtcgcccatctgcgcgatgccgacggtcagcgtcgcaaataccagcggcgcgatgatcatcttgatcaggcgcaggaacacgtcggacagcaacgacacgtacccggcgacttccttcgccatggccgggtcgggaaatgcgctatggcaggcgtaacccacggcgataccaagaatcatcgcgacaacgatgtacttggtgatgttgtgcttcttcttcattagtaatccaaatcacaaagcgtatgttgctaacggctggctaactttcgcgcccggctacgaatcgaaacccacgtctctctgggtgcgacgagtccgcctttggcggtcgccatggcggacagggggcattctaacgcaaatggcccctggctttcaaatctgaaagtcggacgggttgatttgcgtccggatgtcatcgaaaaaccgggttttgtcgcgatcctgcccgcttactgattgcttcctgcctgcttcctgctcgcttcgggcctgtttttccgacccggtcggcgagggtaatcgggccacgccaccgttcgcgccggaattcccctccccaccgcggcatcgcacgatgtgacgacactgcaatcgatcgcgacacatcctcacaaagatgcgcagacctcgacactacggcacgtaatgcgtctgtaatatttcgaaacgtttcgcggcgcccgtccgggcatcggtgcgcaatcacgcatcggcaatgcggaaccgggttcgagtcattgctttcaacacgttgaggcattcattttctcagcagtcctgccaaatgaatgatcgaggaaaggcagcatcgtgatgaacattctgtataccaacttccacggcgactacggcggcggccaggacacctacgtccgcgacctcgccgccgcgatgagccggcaccatcgcgtgaccgtcgcgtcgccggaagggagccgcctgtcgcgactgctgaaggacagtcccgacgtggccatcttcgacatggaattcaagccgcgctggaaccggctctgccaggaaatcgtccggctgcgccagcggatccgcgccgagcgcttcgacatcatccacgtcaacggatccgccgatcaccggcaggtgatgctcgcgctgctcggctgccggtatcggcccgcggtcgtgctcaccaagcacaacacctatcgcgccgacagcttcggcaacatgctgcgcgcccggctggcaaccgaccataccatcgcggtcagcgactacgtggcgagcatgcttgcgctccggtcgccgtacggcaacgtcacggtcgtcaagcacggcgtgcgccggcaggccgcggaacggttggccggcgacgaaatccgccgccgcaagatcgcgctgttcgggccgtccggcgcggatgcgatcgtgctgggcagcagcgccggcaccgcgccggagaaaggctggatggacctgatcgcggcgctgggccgcttgcccgaacacgagcgcgagcggtttcgcgtgctgctggtcggcgcggaaccgtccggcgagcaacgcgagcagatcgaggggcaccacatggcgtcgcgcaccgctttcaccgggcgcctcgacgatgtgcgcgcgccgttctcgatcatcgacgtgtcgttcgtgctgtcgtaccacgagagcctgtcgtatgcgtgccgcgaggcgatgtcgctcggctgccccgcgatcgtgacgcgcgtgggcgggctgcccgagaacgtcgagccgggcgtggacggctgggtcgtcccgccgcgcgagcccgaggcgatcgaggccatcctgcgcgcgatcgtgcgcgagcccgcgtgcgtgcgggcgatgggacgcagcgcgcggctgaagggcaagcgcgagttctcgttcgaccggttcgtcaatgcgacgttgtccgtctatcagaaatcgattcgacacaacccctatcgttgggtgacatccatgaggtccgtttaatggcaatgaacatctggaagaagtactgggacctgcgcacgcaggagtgcccgtgcgacgtgcacttcgtcgaatggctggaatccgctcgtctcaacggcatccgcatctatcacttcggcaccggcggccaccaccacgtcggcgtggaatgcgcacggccgcacctgaacaacaccgtcttcggcgtgacggcgtcgccgaaggaatacaagtcgtacgtcgatctcgtcacgcggcaaccggaggtgagcaagacctacctggcctatttcggcgacatctatacgagcaatacggacctgctgccggcgttcgacgtcgtcacgctgttccatctgtgcgaattccgcgacgaaacgaacagccgctacggcgcgaagaccgacgccgaagtgctcgacctgttcgcacgtcataccgcgcgcgacggccacctgctgttctacaagggctcgtcggcataccggaaggccgagccgatcatcgagcaatgggcggcgaatgccgatttcaccgaagtcggcgacttcaagaccttgcggattttccgcaaggccgcgtaattccccgttcccgcgacccgctcatgctgctgtccgccacgcgctacccgatcctgatgtatcaccagatccgcacgctgccgccgccgtccgaccggctgcgcagcctgagcgtcgcccccgacgcgttccgccgccagatgatgctgttcaggcggctcggctaccgcggcctgagcgtgcgcgaactgcagccgtatctgcgcggcgagcgcagcgggaaggtcttcggcatttcgttcgacgacggctttctcaacgtgctcacgcatgcgatgcccgtgctggacgagctcggcttcaccgcgacctgctacttcgtcgccggccggttcggcggcgagaacgactgggatgcgggtgccgatacggcgcgctcgccactcatgacgtgcgcggacatgctcgcatggcgcgatcgcggccacgaaatcggctcgcatacgctcgatcacgtcgcgctgtcgcacgtgccggcccacgtgtcggcggttcagatcatcgaatcgaagcggcggctcgaagcgttgagcggccagcctgtcgaatcgttctgctacccgtacggcgatctcgacccgcgcgtgcgcgaccaggtcgccgccgccggctaccgcaacgcgacgacgacccggcgcggctgcgccggggcgtccgacgatgcgttcctgttgccgcgagttccggtggcgggcggggtcggtgcgatgcggctttggttcaagtgtgtgaaggcgcgggttccgaggcgcaggtagctcgcgctggatcgactgccgccgaaccctacacccccacgcacctcgcgccgcccccttcggcatacgctcaccgctggaaagccctgcgcatctgcgcgccgcccacgtcgaacacctggcgggctgccgacgtcacgccggccatatggatgcacgcatggatcatccccggtagcacgacgaaatcggccgccacgccggcctcccgcaatcgctccgcatacgcgtgcgcgtcgtcgcgcaccggatcgtactcgcaggccagcaacgtggccggtggcaaaccctcgagcgaagccgcctgcagcggcgacacgcagggtgaccggccgtcggccggatcggtcagatacatgtcgaagcaataccgcatgacatcttgcgtcaggtagtagccctgcccgcaagtccgataggacgtcgtgctcatcgacgcatccagcggcggatacagcaacagctgatgcgcgatcgacgggccgccccgcccacgtgcgaccagacaggcagccgccgcaaggtttcctcctgcactgtcgccgccgacggcgatgcgcgccgggtccagccccaggccggccgcctcgcgcaccacccagtccagcgcatcgcagaaatcctccagcggcaccggaaaccggtgctccggcgcaagccggtaatcgacagacagcacgacgcattgcgtcgcgttggccagcgcgcggcatggattgtcgtatagctcgagcgtgccgaggcaccacccgccgccgtgcgcataaacgagcgccggccggcgtgccgcgctttccgaagcgaccgatggccaataagcccgcacgcgaatctgctgcccgtcgcgcgtgggcaccgcgaaggtttccgtatggtcgaccgcttccaacggtccatgccagccccgcagtgtcgtatcggtcgcccgtcgcaatgcgtccagcgacgcaggcgcctcggtcacggccagtcgctccagcagtgatgcgatgtcggtgtcgatcggcatgatcagcggctccgctccaggaaaggcagcagatggccgatgaatgcgtcgggtgcctcttccatgatgaagtggccgcaagccgggaccaccgcgccctgcagatcggtcgcgttgtcgcgcatcgtgaccagcggcgcatcgccggtggcatgttcggcaccgatggcgagcaccggcatcgtcagcttgcgctgcgcccgcgcctggttctgccggatcgtctccggaatcgcacggtaataggagaagccgccgcgcaagccgcccggtgccgcataggcatcgatatacacattgacggccacacgatcgcgccggaacgaccagcggttgaacatgaactccagatacgcccgctcacggcccgcaatcagcgtctcgggcaggtcggccagctggttgaacatgaaatgccacaggaagatgttttcttccggcggggcgaagatcgacggcgcgggcgccagcccgggatcaccgcctccgtgagcgccagcgacttcacggcgtcgggccggtcgctcgctagcgcataggccacccacatgccgacgtcgtggccggccacctggtaaacatcgaagccgagctgcgccatcacgcgatgcaacgtcgccgccgtgtgccccgtgtcgtaacccgcatgcggccgatcggaatagccggtacctggcggatcgaccgcgacggccatgaagccgcgcgcggcgagcgcctgcatcacgtgacgccacgcgtaccaggtttgcggccatcccggaatcagcaggatcggggtaccggcaccggccgtgacgcaatggatacgctggccgtcgatgcgtacgtattggtgagcaaagccttgagcgtcggcagacgacgactgaagttgagcggacatatcgatgattcctggcagtgggggaaacggctcaagcgatgccgagcatgtcgtggatttgccgttgatcgaccgcggcaccggcgaagtcgtcgaagatgcgctccgtcacccggatgatgtggtcattgatgaatgcgacgccttcgcgcgcgccgtcctcctgattcttcaggcagcactcccactcgagggtggcccatcctgtgtagtcgtactgagcaaatttcgaaaaatcgccttgaagtcgacctgaccgtcaccaagcgaacggaaacggccggcgcgctccagccacgaactgtagccgccgtagatgccctggcgtcccgaaggcaggaactccgcgtccttcacatggaacatgcggatgtggtcgcggtagatatcgatgtacgccagatagtccagttgctgcagcacgaaatggctgggatcgaacagcatcttgcagcgcgcgtgctggccgaccagcgcatggaagcgctcgaaactgacgccgtcgtgcaggtcttcgctggggtgaatctcatagcagaggttgacgccgttttcgtcgcacgcgtcgagaatcggccgccagcgacgcgccagctcgtcgaaggccgtctcgatcaggccggcgggccgttgcgggaacggaaacaggtaaggccacgcgaacgagcccgaaaaggtgcccatgtcggtcagccccaggcggcgtgaagcccgtgccgccagctcgagccgatccagcgcccatgcggtgcgcgcggccgggttgccgcgcacggcctcgggcgcgaagttgtcgcacatggcgtcgtacgccggatgcacggcaaccagctgcccgaagatatgcgtggtcagttcgctgatctccagcccatgttcggccagcatgcccttcatgtcatcgcaataggcctgactgtccgcggcggtctccacgtcgaacagccgaccgtcccacgcgggaatctgcagcgccttgaagccgacgccggccgcccatcgcgcgatattcggcaggctgtcgaacggcgccgcatcgtcggcgaactgcgcgagatgaagactggggcccttgagagtacgcatgatcgattccaattgtttgtcgattgacaaagaatagagtgcgggaacggcgcgtgtcaacacggcgcgcgataaaatccgtgcacgatgtgacgacgggcgaaagggatatggcgggacgaccgagagaatttgatcgcgacatggcgctgaaacgcgcgatgcttgcgttctggcggcgcggctacgaaggcacgtcgatgtccgacctcgtcgaagcgatgggcatcgcgtcagcgcgcatctatgccgcgttcggcagcaaggaagccctgttccacgaggccgtggcactctacgagcaaggcgaaggcggcttcgccgatcgtgcgctcggcgaggaaaccgatgtccgcgcggccgtcgaacggatgttgcgcgatgccgtcgccgcttataccaggcgcggccagccgcatggctgcatggtggtgtccgccgcgaccaactactcggccgaaaacgaaggtgtcatggaatggctggccgcccaccggcgcgcacgcacgcaatcgatcgccgaacgcttgcagctcgcggccgagcaggggcagctcgcgcggggcaccgacatcaaggcgctggccgatttctatgcgacgcagttgcacggcatttccgttcaatcccgcgacggggtatcgaaagagcgcctgctcgcgtccatcgggccggcgatgatgccgctcgtgacggctgtgcgtgacggcgcgtaacccggcccggtcaaccgacacgacggccgtttcaagctcgggcagatcggccggaaaggcaactcgacggacgacgcgacgcccgtcgacaatccggtgcatgaccacaacgaaccacgagttcgtcgtcttcaagacagatctccccgacgatgcgctccctgtcggcaaaggacaggagatggagcacaccctgaaaacaatcggcgaagcggaagatatcgcgcctggccacgacgcgctgatctgcaacaagccgggccgctatgaagcggggatgcatacggcacttgtcgtgacgccgtagatcgtttcgccggaccgaaatccagcccgaagcacccgggcgtcgtccacctcgttccccattacgcgatcacccatcccacgctcacccgagcgaggcgcagcgctttcctggcgagcctcgtgcgagcggctacccgccggaagggcgtgccggatcacacgcgatcgttcaaataaattttgtagaaacagcaaccgagacgtagaattcgctacatgaaatctatttctacatggtcgctgcttgttctgacccttccgacggaaaacgcgacggcccgcatgcggttctggcgcgcgctcaaggcgaaaggctgtgcggtgctgcgcgacggcgtttacctgctgccccacaccgaagcgcatgaagagacgctgcgtgaactcgcgggcgcgattgccgggagcggcggcgcagctcacctgttgcgcgcaccgagtctcgaccggtcccaggaacaggaattccgggcgctgttcgaccgggccgacgattacgcgaccttcacacgcgcgctcgccgacgtgcgcaagacgcttgacgggcaatcagccgccgagctcactcgcctgttgcgtcgcgcgcgcaaggatctcgacgccatccgggcgatcgactatttcccgagcgattcggccacccgcgccgaagtcgccctgcaggatttcggtgcgctggtcgacacggtgctgtcgccgggcgagccgcatgccgcggaccgcgtcattcgtccgctcgcgatcggcgagtaccagggccgcgcctgggcgacgcgacagcggatgtgggtcgatcgcgtcgccagtgcgtggctgatccgccggttcatcgacacgcaagcgcgcttcatctggctcgcgtcgccggcggattgcccggctgacgcgctgggcttcgatttcgacggcgcgacttttacgcacgtgggcgagcgcgtgacattcgaagttctgctggccagcttcggactcgacaaggacccggcactgatgcgtctcggcgagatcgtgcacgcgctcgacgtgggcggttccgccgcgcctgaagcagtgggcttcgaggccgtgatggccggcacgcgccaacggacggagaacgacgatcagttgctcgagcagatgggcgccgtactcgactccctgcatgcgcacttcacatcggacggcaagagcgaaaccccggccaaatcatgacgacgaccatcgccacgaccgaaccgacctactcgcttggcgagctggtcgcctacatgttgcgtctcggtacgttcggtttcggcggaccggtcgcgctcgctggctatatgcgtcgcgacctggtcgagcgacgcggctggataaccgaggccgactacaaggaagggctcacgctggcccagctcgcaccggggccgatggcggcccagctcgcgatctatctcgggttcgtccactaccgccttctcggggcgacactcgtcgggatcgcgttcgtgctgccgtcgttcctgatggtgctcgcgctcgggttcgcgtacgcgcattttggcgggctgtcgtggatgcaggccgtcttctacggcgtcggtgccgcggtggtcggcatcatcgcgatgagcgcttacaagctcacgaccaagaccgtcggcaacgacaagctcctctgggcgatcttcctgacgctggctgccgtgaccttcgtcacggaatcggaaatcgcatggcttttcgttgccgcaggcctgatcggctggctgtggcgcgcgccgcccaggtggctgcagcggggcgggctgaatgcggttgccaccgccaacttgccggcagccagcgggctactgagtggcatcgacctgccgcagctcgtccagatcggtgcgttcttcatgaaggccggcgcgttcgtgttcggctccggactcgcgatcgtgccgttcctctatggcggcgtcgttaccgaacatcactggctgaacgacaagcagttcgtggatgccgtcgcggtcgcgatgatcacgcccggcccggtcgtgatcaccgtcggctttatcgggtacctcgtggcgggcctgcctggcgcatgcgtcgccgcgctcggcacattcctgccgtgttacctgttcacggtcattcccgcgccctacgtgaagaagtatgggcaccgtccaggcgtcaaggcattcgtcgatggcattacggctgcggcagtcggcgcgatcacgggctccgtcctcgtcatcgcgaagcgatcgatcgtcgacgtcccgaccgccctgctcgccgtcacgaccgtgctgctgctgtggcgcttcaagaagctccaggaaccggtgatcgtgacggcggccgccgtcatcggactcgtggttttcccgcttctccaccactgactcgcgtcaccgggaaacgaacatgacgtaccaggccaggacgttgcagtgcgatcgtcgttctcatgttcgagaagacgacgcgagcgaccgggcacggagcaagcgatgcgaacgtgttgcgtgattgcgctggcgatcgcgctgtccgtcgcgctgcccggttgcgacaagactgcgcccgatcaggggccggcgagatcgtgacgctcgagcacgcgccggaggcggtgagagcaatgatcgagcgtcaacggcaaggcggcaatgtcggcgtgattcaacggcgtgtgaagaacggcaaggcacgctatgtcgtcaccatcgtgcagggtggccaggagcaacgcctgagcctgaccgaggacggccggctcatcagcagccgccccgctggcgacgacgaagaggacgacgactgacctcgacgcggccaagcaccgtaccttgttcgcgcgcatcatgcccacgatgctgcggctgccggccggcttcggccttcaacgaaccacgcgtgcacgcgactgcgtagtgccatccgctcacggtcgacaggcgttgcatttcatcggtgacctgctcaccttgcgtcgaagtgagcgtgcgggtcagcggaaatggccttgtccgattcctgcaacgccagttccgccgcaacggcattcgccccggccttgatgaacacgtcgagatcggccgtgggcaggaagcgcttcatgatcgcctccagttcggcctttccggcatcgtccaggctgcgattgccgttggcgaggcgggccaccgccgcgcgatagcacccgatataagcacgctgtgcggcaatcatgtcgagcggcttgcccgcctgaccgtggcccgtatagaacagtgcgatgtcgccggaccgacgttcgagcgcatcgaggctgcgcagccagtccgccgtatggccgtcgttcatgaaggaatggacgccgttgaacaccatgtcaccgacgaaggcgacacgctggtggtttccacggcccagaccagatcccagttcgattcgccagggccgaactctcttgcctcgaacggcacgccatcgaaatgcagcacgtcgccgtcatgcacgaggcgattcgggaaggtgcgccgcgccggccaatcgtcgccgaacaccgactgccactggactgccttggcatcgtcgacacggcgcatcgcctcgtcgacgccccgcgtcgtgatgaccggcacatcatcaagatcgcggatcagctcgccgatgccgttgtagtgatcgggatgcccgtgcgtgatcagcaccgcgagcaagggtttgcgcaatgcatccagccggtgacgcacctcgcgcgcatccgatacggtcatcatggcgtcgatggccacgacaccgttcggcaattcgaccagaaaggcgttggtgagaaaggtgcgtgcaccggacgtgcacgtcaccacattgatttcaggcccgttgaaatcgatcatttgaaagtgctctcgtcaagaagctgttgctttatattggtcggacgctccggcccataccgcgtatgcggttctcaaaggcaggatcttcaatgtgacgctcattcgccacacgctcggcacggccgccgcgatggatatcgcgccagacagtatctttgtgtcgcgcccggaacacaactcccggtaatccggaagcaagagcgatcgatcacgccgcaagcggactggagatggcaagcatgcgcgttgccttcattggaagcaggctgcaacgcttaagcttcggtcgattcgagaggattggagcgcatattccagggtagtagcctggtgtaaccgtcgaccgtctgcgcgagcgggagacattgaggcaaccggatcagatagttgcacgggccgatcccgttcgccttgcaggtctcgacgagcgagcagaggttggcgctggtgtgccgatgctgcgcctggtcagaaagtggatgcgtgacacacgcgaccggagcgggtcgggcgtaacgccggtcgaccgcggtgaagcgcggaatccggatacgccgtcgtctcggcatcgagcgacgtcgcatcaattgccggaatcctcgatcgcctcttcgaatacggccttgaaccaatcgatgaaagtacgcagcttgttcggcatatggcgactcgggtaatacacgatgctcaccggcttcgcttccgcaacgctgcctcgcatgatctccgtgagcgacccgtcgtcaagatacgaacggagcgcaaagcggtagcccgagatgatgcccagccccgctaacgcgcatgaaatgaccgcatccgcgtcgttcgccatgacccggctcctcatcgcaagcggcgcggccttgccgccgacatggatctcccagggtttcagtccggtcccgtcatcccatgcggctgccacggtcacatggcctttcagttctgcgagcgtatggggttcgccgtagcgtgccagataggcgggcgacgcaaccatgattcgatcgatccatcccacgccctttgcgatcacgctgttctcccgcacggtaccgatgtggatcgtgcaatcaaccgcgtcctttgcgaaatcgaacgggttgtcggagatcgccatctccacatcgagtttcgggaatgcatcaagcaacgacggcagcgcgggaatcagcacgctcttcgcaatcgcggaggacagtccgaccttgatccgcccctccggcgcgcgcccggcgctcgctgcctccgcgttcatgttgtcgatctgttccagcacgcgaacgcaggcatcgtagtaggcacggccctcttcagtcggactgacggtgcgcgtgcttcgattcagcaggcgcacgttggcctgcttctcgagatactgaacgaggcgcgacactgtggcgggcgcgagatgcagatgcctggccgctgcggtgaagctcaaacagtcgaccacgcgaacaaaggccttcatcgccaccaggcggtccataacgtcttccttttacgattgcatcgcccggtggatggacggtaccttcatcacgtcatggtcccgtgccacgcctgcttgtcgtcgatagcccgggcagactgtgcgacgtcggcccgatagccgcgttcatcgcggcaaattgaggcaaggcacagtcgaagccagtgacacgttcgctgccctggattgtcccgatgcagtcgccttcacgaatcgaatacgcgatgcctccatcgcctcgacacctcccgtgatctggctcgccagttcggcaagtgcgcgccggtggccgaccacgagcgcgtcgtagccgtcggcgaccggttccgcgacgctcgtgcggcaggtcatcagcgcctgcgtgccgagcgcgcgcacgctccacacggcatcgaccgccgcgcgtttgcccggccacgactcgaagcgctgcacgttcacgctgatgcgatacacgggcacgccgggcggatacgcggaattcgcgacgtcgatcgtgccgagccgcgcggcgagatcgtccgacagcgcgcggcggatctcgtcggcaggcggcgacgcccagcgttcctgctcgagcacgtcgacctgcgcggcgttcttctgcacgaccagttggttcctcgagacctgctcgggcacgccgaccgacggcacctcgatcaggaacgccgggttggccggcgcggtgcgcagcggcgccgcggcgtcggccgggctgagcgtgtagaaccgcgcgggcggcgaactgcacgcggcgagcgcgagcgcggcgaaggcagccgcagcaccgctcgcgaaaccgttcacgcgtgtcgtcatggttgatctcctggcttgcccttgagcagcgattcggggtgacgctcgagatagtcggcgagcatgttgagcgactgcagcgtgtgcgtcagctccttcaacgcgccgcgcacgtcggactgcagcggcgaatcctgctgcagcgtcgcttcggcggcggtgaaggtctgcttcgccgccgacaatgtgtcgcgcgcctgtggcgcgacctgcgtgtcgagctgcttgaacagcttgtcggcattcgacagcgcgctgttcaggttcgcaccgatctggtcgaacggcaccttgtcgagcttcttcgcgatgtcggccacctgagactgcagctcgtcgagcgtgttcgccacggtcggcagttcgacagtctcgtgactgacatcgagcttcacggccggcgccgtcgggaagaaatcgagtgcgacgtagagctgactcgtcaacaggtttccagtgcgcaactggccgcgcagcccgtgctcgacgagccgctgcaggatctgtcgacgctccggttcgcccttgctgcgaatcgcgtcccggaaactcttgccgagccgttccggatacagattcatcgtcaccggcatcttgaagttcttcgccttcgcgtcgtagtcgataccgatgttcgtcacttcgccgagcacgatgccgcggaagtcgaccggcgcacccaccgcgagtccgcgcagcgactggttgaagttcatcacgaccggcacgcgttcgccgtcggggtcgcgcatcgcctgcccctcgtccgatgccagctggaataccgtgtcgtgcgcagccacttccccaggcggttgatcggccggagactggaacgcgataccgccgagaatcacagtggcgagcgattgcgtgttcagtttcaggccgctcgaatcgagacgcagatcgacgccgctcgcctgccaccagcgcgaattttcatgaacgtactggtcgtacggcgcgttgacgaacaccgtgaacgtcacgcccgtgccgagcttgtccagcgagaagccgaccacctgcccgacctgcacgcgccggtagtacaccggcgagccgatatcgaccgagccaagcgaatcgccgcgcagcgtgtattgcgtaccgcgctggtcgcccgtcacggcaggcggcgtatcgaggccggtgaacgcgcgcgcgcgatccttcgaacggcccgcgtcgacgccgatgtatgcgcccgacagcagcgtgccgaggcccgatacgccggtcgcgccaatgcgcgggcgcacgacccagaagcgcgaccccttcactgcgaagtcttccgcttccttcttgagcctgacgtcgaccagcacatgcgacagatccttcgcaagacggatcgcgtcgaccgtgccaacctcgacatccttgtatttcacctgcgtcttgccgggctcgagcccttccgcattggcaaagcggatcgtgatttccgggcctcgttcgcgcaccgacttgacgacgagaccgatgccgatcagcgccgcaatcagcggcacgagccacacgagcgacggcagccaaccggcgcgcttcgcgaccgccggctcggcaatggtcggtggttggccggcacctgcatcggaatcgcggtgcgggccttgcggactattcatggtgatttccagaggtttcaacgggatcccagatcagacggggatcgaactgcaacgacgcaagcatcgtcaggatcacgaccgagccgaacgccagcgcacccggaccggcggtgatgacggcgagcgaccggaagtggacgagcgcgacggtgagcgtcacgacgaagatgtcgagcatcgaccagcggccgatgtgttcgacgacccgatagagcgtggtgcgctgcatcggccgccaggtggaacggcattgggcggtgatgaccaggatcagcagtacgcagagcttgagcatcggcacgagaatgctggcgacgaatacgaccaccgcaagcggccagtcacccgacacccagaaatagaccacgccgctcatgatcgtgtccgactgcgagccgacgatcgacgatgtacgcatcatcgggagcagattggccgggatgtacaggatcaccgccgcgagcagaaacgcccaggtgcgagcgagactgttcgggaagcgcgagtgcagcgtgctgccgcagcgcgcacaatgggccggcacgtcatgccgatcgacggcaagcgcctgaacccggccgcagacgtggcagctcgccatgccttcacgggcagcggtagtcgtcttcattggaccgtcgcctcgtcgctagcgtggttgtcgccgcgcagttcgtcagccagatcccacagcacacgcggatcgaacatcacgacgacggtcaacatcagcgtgagcgccgcgaacgcgaacagcgccgcttcgggcaccacctgcgcaaggctcaccatcttgacgatcgtgacgaggatgccgagcatgaatacctcgatcatcccccaagggcgcaccaacccgatcgcgcgcagcaccgtgccgaaaccacgcggaatgcggccggcgcgcagcggcagcatcacgtacagcagcgctgccatctcggtgagcggaaacagcagcgtcgcgcagaacaccatcacggcgacgatgcccatgccttgatcccacagcgcccgcaccgcacccaacagcgtcgtctgcacgtgcatgccgttcacgttcatctcgaggatcggaaaaccctgcgcgatcacgaacgtgatcagcgcggccagcgtgagcgcgcagacacggtcgagtcgcgacacgccgccccgataaagcagttcattgcaacgcgggcagcgcgcctgcatgttcccggcgagcggccgcttgcgcagcaacgtgtcgcaggtatggcaagcgatcaatgcagtgcgggacatgcggcggcactctctctacaggttgcgggccatgggccacggatcgacgacgcacgcatcgacgtccgtcggcatggcgcagtcgcggcgtaaccgttcatgcgtcgatctcgcaaatgattcgccggagaaatcgtctgagaaacatccgttcctcctccgacaaccgccccagcacgatccgctcggcctcctcgacgacgggcggaacccgctccgcgatctctcgccccttcgacgtgagcgacagattcagcgtgcggcggtcccggccatcccgacgccgcacgatcagcccgcgacgttccagatcctgggcaagtcgtgtgaggcggcttgttccgcagccgagcgacttcgcaagcgcctggcatgacgtcgcttcgctgcgggcgagatgggccagcgcgttgccctgcgagaactgaaccccgagcgccgtcagcatcctctcgttcagcacgttccggatcgagatctgaacggccatcatcgtgcgaaagccgtcggcctcgcgcggcacgtcacgaacggacgatcgtagtgactgttcgaacatgagcggcattacctcgggttgaggacgaccggtgcatccgaccggtagccaccgccgagcgccttggtcagcgcgatgtcctggccgatccgacggccgtcgagatcgagcagcgcgacccgctcgagaagcacggcctgcttcgcttcctccgccgtcaggcgactgcccagcccactgcggtagtgcgcgtcggcgctgtcctgcgcaaacgtcacggcctggatcttctgcgtctgcagcttggcttcggcgtcgaggtcctgcagttggctgcccgtcgtggcgacgtcccgcacggcgttcaggaccgactggttgtattgcaggatcagcaggtcgctcgcgtgacgcgcgttcccaaggttcgcattcagccggcccccgtcgaacacgggcaggtacagcccgggcacgagattgatctgctggctcgcatgcgtgaacaggtcgcccagatgcagcgcgttgacgccgaaaaatgccttgatgtcgaaactcggatagaacgcggccttcgccgcgtcgatcttgtcgaacgacgcttcgacataccagcgcatcgcctgcaaatccgggcgccgcgccagcagttcatacgacagcgtcgacggcagtgccgacggcggctgcggcaacggcacgggcgagatctccggcagatccgtcggcccggcgccgagcagcgcgcgcagcgcttcacgcaactgcacgatgcgcccgcgagcagccaccagctgccgctccgtcgccagcttctgcgcgcgggcgagctccgcctgcgtctgcggctcgagcccgcgtgcggcgcgcgcggcgtgcgcctccatcgagaacgcggccacgtcgcgcaattgttccagcaggccgatgaggcgataggtcgtctgaatgccgtagtagagctgcgcgacgtcggcggagacctccagctcgatcgccgacgtctcgaccacccgcgcgttgtgcatccccagcgcggcctcgacctgcgcacgctgcttgccccagatatcgatatcgaggcttgcactcaggccgacgatgccttccgtgtaccacggcccggtcgcacccagcagcggctgattgccggaatacgcgcccaggaagccgttgcccgacacgcgctcccgatcgaccgacccgagcgcgctcacctgcaggttggtccccgccttcaccagatcgacgtcggatttggcctgcgatacgcgggtgcgcgcgatcgccatcgtcggcgaatcggccagcgcccgaccgaccagcgcgtcgagctgcggatcgccgtagcgcgtccaccagcgcgccgacggccagccgtcccgcgccaggtggatgtcgtcggcgatgcggatccgatccggatcgagtgtcgtcgtgggcttggtgtcgtgacgaatcagcgcacatgcggacagcccgcacagcagcaccgcgacggttatgcggcgcaacgacgaacaggaaggtcgaatcaacgaatcggtcatgcttgggaagctcgggaagtcaatactgaagcgacgggttccggcgcccaggcgggcagccctgctatctggccggcgagatcgccggcacgggtcagcagccggtcgtacgccgtctgcgacgcgtcgccccgtcgggcggacagatcctccgtgcagcgctccgacagcgttgcgatcgatacacgcggtggcgcgtcgatcgtcaacgggtgctcgaccagcgcgtcggcataactgtccagcgcaccggccagctcggcctggaacgccgccgtcgcgacggcaacctcggccggcaggtgctgtgcatccgctccgcgccgaacgcatcggtcgccaacaggatttcccgcgtatgcgccagcagcgtctgcacgcgcaaggtcaggccttcgtgctcgccgtccgccatctgccagcccggttcgagcgcgacacgcgccgacatcgcctcgctgtcgcccagttcggcccacagcccgaccggcaccggcccggtcgtgtccgggcgaagttgcatgccgatccggcgcagcagcttcgccgcacgctgacgcagcgcctcgccctcggcctccggccatagaaacgcatgagcgaccgcggacacgacgacgccgagcacgatgccgatcatccggtcgcggatttcagtgagattggtggtcgggccaaagtgctcgagcacggccagcgagaacgtaaacatgatttgcgtacccgcgtaactgatacgctccgagcccgccgatacccacgctgccagcgcgatcaccggcagcgtcatcatcagcaagccgacgatgccgtccagatgcggcatgacccagacgaccatcgcgagcgccagcatgctgccgaccgccgcgccgccgatccgcagcacggcacgctgcgcggatgcgccgaggctcggttgcgcgacgatcaggcaggtcagcatcatcgtatggatgccttgccagtcggtcgcgacgtagaacacgtagctgcacatggccgccatcagtgtcttcagtgcgaactgcgcgtagacggggttggtgacggcatccggcaccagcatgcgctccttctcggccctggactgagcgtcgggcggggcggccgaccggtccgagaacgtcagcaaggcgtcgcgtatttccgccagcgcgcccggcaacccttccgccgccagtccggccagcgcgtccggcgcgacaaaacgggcgtccgtgccggccgcgtcggccaggcgccggacggcgtcgcgcagcaccggaagcgcatcggccgtcgaccccgtggcagagcccggcagatggcccgccgccgcgtacaggcgcgacaccgtcgccacgcgggcgagatgcaatgcctggctcgcgcgatacgcggggtcgcgcatcgtcgcaaagcggagcagtttctgcagcgtcagcgcaccggcctggatgtcgcgcgccgtcgggccaccctccgtcggtgcgcgctgttcgagcgcggccaggcgcgcgtcgacggcattgagttgcccgcacagggccgcacggagctgacgcaccggttccgccggcaggaacagcgtattgatcaggagcgtaaccgcgatcgcatagttgaccgcgacccatacccaaagcacggcgcgcaccagcagttcggcctgatcggtctggtcgacgaaggtctgcgagtaaatgaccacgatggcgacgatgaagaacaccacgccgatcttcgcgacccgcatcatgtagacgctgaagaaaaacagcgcacctgccagcagtatccgcaacagcggatagtcgtaggtgaacttgaacaccaggatcgaactgccgacggcgagtgtcgaaccgacgacgaacaggacgccgatcaggcgcgtcaccacgacgttcgcctgcgtcacgaagaacaccacgatcagcgacaccgccagcaacggcacctccagcgccatcgacgcaacgatgacgatggcgctggcgagcacgcagcgcagcatcacgttcatgcgccccgggtacgggcgaatctctccgccgatgaagcccgcgaagcgctgcagacggctcggcgagaattgcgcggtgctcatgccgcgctcaccgtgccgtgtcgtgcgcagcagcgtcgcgcctgagcgtcgcgaccgccgaggtgccgacccggaacaggttcggatccgggtcacgcaccgcgatcttgaccgggaaacgctgcgacacatgcacccagttgatgctgcgcgccacgcgcggcagcccgtctagcaccacgccgccgtcgtcgggcagcacgccgtagctgatcgaatcgatcgtgccgccgaagcgcttgccggtgtcgctggtcagatagaccgtggccggcattccggcgcgtacgcccttcagatcggtttcgcgaaaattcgccaccacgtaccaatgacgcgtgtcgatcagcgtaaagaccggcttgagcgccgaagcgaactggccgaccgtcgtgcgcaaggaagccacccgtccgtcgaacggcgcacgaacttcggtgtactcgagattcagttcggcgatcgcgatctgcgcttcgacttccgcacgctgcgcgaccagcgcatccacgccgctcaccgctgcggatgcctgctgcgcctgcagcatcgccgcgttcagttccgcctgcgccgcgcgctgcgcggttcgcgcccggtcgacgtcctccgccgacgtgtagcccggcgcgagcagcggctccatccggtgcagcgtgtcggctgcctgcgcagcctgcgcgcgcgagcgttcgaccgccgccttgacggaatccgcgttgtactgctgcgcattgaccgtgcgttgcgtcagcccgatctgcttgtcgagcgtcaccagccgtgcgcgcgcctggttcagcgcgtcctggtacggccggggatcgatccggaacagcaggtcgccctgcttcaccgtctggttgtcgcgcaccggcatctcgacgatcttgccgttgacttccggcacgacgttgatcgtgtccgcgtagacgtatgcgtcatcggtcgtcggcgactggtcgagacgccacacgacaacgccgagcagcaccagcgcggcaatcacgatgagccatgcaggcagggactttttgcgcgatgcgccggaagcgtcggacataacggtacgcgagatcagtggggaaagaaaagcagccagaacgccatcgcgagcgccgcggcgagcgcgggatagctgatcgccagcggcgcgagcagcgcgcgcttgccgcgcttgcccagcacgacgtgaacgaccgtcgtcccgagcacgccgccgacgatgcagaacagccagtccggaaaagctgcgccgaatacggcgaccgacggcgcggctgcacatccttcgagcagcaggctggccgcgatcgaagcaaaactcagggcgatagacagacgcatcggcaaatgactcaaggcaacgggcgaaagcggcatgacgacatgacgcaagattgattcgacgatcgaacgaacgaacgcggcggacggaagcccggacggacgcgcaatgaccggagccggatgcctatcggctgtttgagcgggagtcctcaccgggcccggcacgcgcagtgtgcgattcggctgttgatggtaatcgcggtaatcggtcgatgaaatggtgaaacatcatattgcgattgtggtctttcacaatactgtgatttcacacaaatccctttgtggataatcacaacgcctcgaccatctctcatctgcaaaactcgcggcacgcccttcacacaaggctcgacgggccttcactcgcccgctgcgccgtagcgtataaattttgcaatcccgatatttacgttgactttgcgtaccgctcttgattataagaacgtcaattcgaaattgagacaacgtggtgatggagatattcgacgcacttcatctcgcgctgccgcagttcgcgttcacggtctccatccacgtcaccttcccggccatccgcatcggcatggccggcttcacggcgcacaaacacacttgccctgttcccaccctgtttcgtaatcctttgtttagttggttcagcagcacgatcgccccgcacgtaccgctcacgcatatcggagcactgcccgattgctcggggccttcgccaggagtcaaatcgtatgacaatttccatccccgacatttcgccggccttgcgccgatggaccgccaacgtcgccgaaaataacgccgcattcgttgaacgtgtgtacaaggcgttgatgaacatcaagccctatgccgacctcgattcgacgacaaagctcgatatccgggactcgatcgtcctgtcgtcgaaactctggctcgacagcctcatgtcgggcaagatgccgtccgaggatgcgcttgaagggttccgggcatacggacgccgacgcgtctatcagggtgttccgctcgaagcactgctccgcgcattccggctcggatcccgcgaactgtggtgcttctatatcggagtggccgggaacgacgacgcgcttcgcaacgaactcctgcttcgaatctcccttacctgctggagttcttcgacaacatgtcgcaggaaatcgcgcagacctttctggaggagcagtacaggcaggcccgctggcgcgaatcgctgcgctatcagctgcacggcatcatcttcaatttccccgacgataccgatgcgttcaataagacggcggcggcgctacgtctcgacgtgacaatcccgagagtggcattggccatcgacgtcgaatcgatcgacagcaattcggccaccttcaagaccgagatcgaccgcatcgttgcggcagcggcccggcgcctcagagtccctgtcgacgatattttcgacatctggtttcgcgggcagttgctcatgtggataccggagcgcctcgggagacgaccggtgcgaacgatagtcagatggccaggcaaatcgcatcgatcgcggacacgctgcccgaagtcagggcgatcggcgtcgggctgccgggcgaaggtgcatcgggctgggccatgtcggccgacgaagcgagccgggcgctcagcttcggccgaagccatctcgacgaggcgcgcgtgcgcctctattccgagatcgcggtcgaggagagcatacgtggcacgaaacgcacgctgacttacctcacgtccctggtcgaacaactggcgggcgaacccgatctgctcgaaacccttcgaacttacttcgaccagctgcagcgacgaaaggcaaccgcgagcgtgttgggtatccatccgaacacgctcaactatcgcctggaacgcatcgagaacatcgtcggggcacgcctcgatgacgccggctggatctcgaagctcgatatcgcgatcaagctgcgcggcgcggccaggtgacgaacgcatcaagcgatgcccgacaccatttttcattctcccctccgtactcgaatatctccatggaaagctggacgatcggcattcttctcggcatggccaacattctgcttcacgcagcggcgatggtatggctcgctgtcgtcgcgcgtcgacttcgcggcgtgctcgacatgcagcgcgacaccattcatgtgcaactgcgcaaactggtcatcatcgttgccttcatctgcatcgcgctcggcctgcttcatacgctggagtcggctctgtgggccgtcgtattcgttcaactcaaggcactcaactcgttcggcgacgcactgttcttctcgatcgacaccatggcgacacgcggcgcgtcgggcctttccttgacggaaaactggcggatgctcggtgcgatcgaatcgtctgacggcgtactcctgttcggcatgtccaccgccttcatattcgccgtgattcaggccgatttcacagcgatagcgcacgcgctgcatcgtgccccctcttcccgatagtccccgcacaccggataccggcctgcaagtcggtatcgaccctacggagcgccgtgcgccgcacggccatccgccatctgcgccacgcttcgcgcagtcgcgacattctcctgattattcatgcctggcgagcgaccagccctccgcggccggcattcgttcgtcgatcgcatgtgaattggaaaaagagctaactgcgttgtgagatcccacatatgcatcggatcagcgtcaccttaagatcgatcttagtcagcaccacttacttgaatgaaccgcggtaagaggagtcgcatggatggatagtggcgtacccggtagcgcgatctggacacacacggttggcatgctcgacggcggtaaccggcgtagcgaccactcgtcgtcttccgccgccgtcggcgggcgaagtcgtcatccggatgaagcgacgtctgcccccaccgtccgcatattgggccgcaaaagcgactcgaccatctacgtatcctggcgcgatccaaccgcgtgccactacggtgaccagatgtggaagctccgtatcgccaaagtgcccggcacttgtgcgctgtcgcactgcaccatccacgtcggtgacctcgtctatcggccgattcacgcgcggttgcaatcgaaacccgtcaaccgacatttcatgatcctggcctccgcggtcgagcacacccgaatccaggacctctgaccctcgtcttccacccgtttctcggcgccgcaagacgccaccacgagacgattcgttcgcctcttccgattaccgcaggccaggaatcatcgcgtgccttcttctggagaaatccgttccatgcccaattgcctgtcacttccaattttcagcacgctgctctacgaaaagaaggcgtcggtcgcctatgtgacgttgaaccgtcccgacgtgatgaacgcgttgaaccaacgggcgatcgaggaactgcatgcggcattcacggatgcacgtaacgatgcatcgattcgcggcgtcatcctcaccggtgcaggcaaccgtgccttcatcgccggcgccgatatcggcgaactggccagcgccacgccagtcgaggccgagcagcgcacgcgtgccggccaggcgctgctcgatttcatcgaacgtctcggcaaaccggtcatcgccgcggtgaacggcctcgcgctcggcggcggatgcgagaccgcgctggcttgcacgatccggctcgcgagtcccggcgcgaagttcggccaacccgaggtccggctcgggctcattcccggcttcggcggcacccagcgactgccgcgtctcgtcggcaagggtatcgcgctgcaactcatcctcaccggggaaatggtgtcggcggaagaggcgcaccggatcggcctggtgaatgaaatcgtggccgccgaccagctgattgcccgcgcggagacgatcctggcgcaaatcgccgccaatggaccgctcgccgtcgcgtatgcaatggacgccgtccacctcggtttgaatgcggcgatgccggaaggccttgcgctggaaggaaaactgtttgcgctgtgcgccgcgaccgacgacaaaaaggagggcaccacggcctttctcgagaagcgcgcgcctgtatttcacgggcgctgacccacaccggcaccttcgcccggagcggcaatcggggcacgccccaccgacgccgctcctctctcaacctcgaattcggaacacttccatgtcagacggaaaacacgtgttttcaggcctcaaggtactcgacctcgcgagctacattgccggccccgcggccacgacgatcctcgccgacttcggcgcggatgtcatcaagatcgagccgcccggcaccggggacgtctatcgcttcttttcgatcattccccgaaccccgtcgccgatacgaactacgcgtggcagttgacgaaccgcaacaagcgcagcatcgcgctcgatctcaagtcggaaggtgcgcgcgaagtgctgacgcgcctcgtccggtgggccgacgtcctggtcgtcaatttcccgccgcgcgtgcgggccgcgctgggcgtcacctacgaagacctcgcgccgctcaatccgaagttgatctacgccgacattaccggctacggcgcgcagggcccggaagccaatacgccgggcttcgacgtcaccgcgtactgggcacgttccggcctcatggaagtcacccacgacgccggcagcccgccgacgcttcccattcccggcatcggcgatcacgcgacagcgacaaccctctacgccgcgatcgtcaccgcgctttacgagcgcaccaggaccggcaagggcggccacgtcacgacttcctgatcgccaacggcatctgggccgcggcggcatgggtcgaaggcggactcaacggcggcaagttcttcccgcagcatgaccgcaaaagcccgccgaatgcgctgctcaatccgtaccagacgagcgacgggcgctggatcctgctggtcgccgcgcaacgcaaggagtgggcgcccttcgtccatgcgatcaacaggcccgaacttctggacgatccccgcttcgccgacgaacaactgcgcgtgaaaaacgcggccgcgctggtcgacatcctcgatccgttgttcgccggtcaaacgctggccttctggaaacaggcgctcaccgccgagcgcgtgattttcggtgtcgttcagatcgccgaggaaatcatcaacgatccgcaactcgagatcaacgggatcgtcgtgccgctcgaggtgccgggacaacctgccacgaagacggtcagcaatccgatccacatcgcgagtcagcagaaggtcaagcctgtcgcggcaccgcatctcggcgaacacggcacggagatcctggccgaaatgggcttcgacgatgccgagatcgcccgtctgcaggatgcaggcgtggtcgcccgcttcggcgaccagacctgacacatcgcgcggccacatggcttgaatgcctccctggcaaccccaccggctggccgacgccagccgtacacacggagcctttcatgactgaagacgaaatccgcgctcacgcgtatgccatgccgatcggcagcccggcttatccgaagccgccgttccggttcatcgatcgcgaattcatcatcatcacctatcgcaccgatcccgaagcgctggctcgtgtggtacccgctccgctgcttccgaccgaaccgatcgtcaaatatgagttcatcaagatgccggactcgagcggcctcggttcctacaccgaatcgggccaggtcgtccccgtatcgttcaacggcgcacccggtggcttcacgcatgcgatgtacctcgacagcgaagccggcatcgcttccggccgcgaattgctcggctttccgaaggtactggcccaaccgaagctcgaaatccgcaacgacgcgctggtgggcacgctcgactacaacggcgtgcgggtcgcaaccgcgaccatgggatacaaatacgagccgctggatcttgccgctgtcaagaagaccctcgaagcgcccggcttcctgctgaagatcctgccgcacgtcgacggctcggcccgcgtctgcgagctggtcaagtattacgtgagcgacatcaccgtgaagggtgcgtggaccgggcccgcctccctggaactgcatccgcattgtttcgcgccggtcgccaagctgccggtgctcgaggtgctgtccgccgtccacatcctcaccgatctgacgatcgcgggcgcggaagtcgtccacgactatctgcaggcacccgcgaacgcctcctgaaaccgtatcaaggacatcatcatgaccgcccctcgaagcccaaccaaccgcttccggcccccgatagcgatttctacctgattcgcgagttcctcagcgaggacgaacgcgcactgctgaagcgcgtgcgcacgttcatggaagaacgcgttgcgccggtaatcaacaagttctgggccgcggatgcgttcccttcgagttgatccccgaaatcagggacctcaacatcgtcggcgtcggattcgaaggctacggctgcgccggcggcagcacgcttctcgacggcttcatcgcgatggagctcgcgcgcgtcgactcgtccatctcgaccttctacggcgtccatagcggcctggccatggggtcgatctatctcggcggatcggaggagcagaaacagaaatggctgcccccgatggcacggctggaaaagatcgggtgcttcggattgaccgaaccgctggtcggatcgggtgccggcggcggcctgctgaccacggccaagcgcgaaggcgacacgtgggtgctcaacggccagaagcggtggatcggcaactcgccgtggtgcgacatctcgatcatctgggcacgcgatgtcgacgacaatcaggtcaagggattcatcgtcgagaacaagacgaccccggcttctccgtcgaaaaatcgagaacaagatcgcacttcgcgtcgtacagaacggcgtgatcacgctcgacaactgccgggttcccgaagagaaccgccttcagggcgacgtgtcgtttcgcgacacggcacgcgtgctgcgcctcacccgtcaatacgttgcgtgggaagccgtcggttgcagcatgggcgcctatgagcacgcgctgcgttacgcgcagacccgcgagcagttcggccgcccgatcgcgtcgttccagatgatccaggaccacctcgccaagatgctcggcaatatcactgcgtcgcaatgcatggtcgtccggctcgccgagttgcaggacgaaggcaagctgctcgaccagcagtcgtcgctggccaaggcgttctgcacgagccgcatgcgcgaaaccgttgcgtgggcgcgcgagatcttcggcggcaacggcatcgttctcgactacaacgtcgcacgtttcttcgccgacgcggaagcactctactcgtacgagggcacgcgcgaaatgaatcacctgatcgtcggcaaggccgttaccggcttcagcgcgttcgtctgaacccactccattcgaaggatcaaaatccatgagcaaggaaatcaaacgcgtggccatcatcggcaccggtgtcatcggcgccagctgggccgcgctgtttctggccaagggcctggatgtcgtggcgaccgacatcgccccggatgccgagccgaaactccgcgcattcatcgatgcggcctggcccgctctcgagcagttcgggctcgcgccgaatgcatcccggagcgactgcagttcaccgccaatctcgacgaagcggttaccggcagcgatttcgtgcaggaaaacggccccgagcggatcgacttcaagaaggatctctacaagcatctcgacgccattctggcgccggacgcaatcatcgcgtcgagctcttcgggcctgacgatgagcgaaatccagtcggcctgcgagcgccatcccgagcgctgcgtgatcggccatccgttcaatccgccgcacctgattccgctcgtcgaaatcgtcggcggcgcgaagacgtcacgggaaacgatcgaacgggcaaccgcgttctatacgagcctgggcaagaaaaccatccagctcaacaaggaagtgcccggccacgtcgccaaccgtcttcaggccgcactctggcgcgagatcgtgcatctgatctcggaagacgtcgtgagcgtcgaggacgcggataccgcggtgtgctggggccgggcctgcgttggggcatcatgggcccgaacatgctgttccatctcggcggcggccagggcggcatcgaacacttcttcgaccagttcaccggcccgatgactgcgtggtggaacgtgctcggttcgccgaagatcacgcccgaacttcgccagaaggtgattgccggtgttcatgaggaagtcgccggccagtcgatcgatcagctcgcagcgcgccgcgacgaagtgctgctcggtctcctttccctgcggcgagacgcaaactaaggccgccgttgccgtgactgccgggccgaccggcccggcagtccctatcctttgccattccgatgtatcgagcgcggctgaccacaggcgtgctcacctctccggacatcgacgcaacaggtcaattgccgccacgcattcgcgacgtgtttcacttcgacggcaatcccgctcggaaaacgtcgcgcgttacccgtgccatacgtcgcttgcgtacgctggaacatgaagtgttccgaatcggcgccgagccctcggttactacgctcactcgccgcgaaacggacgcaaatggctgtgctagcgaaccgccatgcgctcaccgaggtgtgacgtttccgtgagcttggatcgcatcgaatcctgaacgacggccgatgtcgtctgctccagggtcgcgatgaagtacctgggtgccacacccagcccgaggacgatgaccgccagcggaacgagcagtgcacgctcccgccggccaagatccgtgagtcgcgcaactcgctcgttcttcacggcgccgaatatgacccgcctgacaccacgcagcgtgtaggccgcaccgagaacgagcgtcagtgcagcagcgccccgatccagaaattcaccttgatcgcgcccatgatcacaagaaactcgccaacgaatcccgaggtgcccggcagcccgagattggccatcgaaaacagcactgccagggtcgcatagcggggcatgacgttcgcgacaccgccgagcgcatcgagcgaacgtgtctgcgtccgttcgtacaacatcccggtgcagatcagcagcgctcccgaaacgaggccgtatgaaatcatctggacgatcgcaccttcgacggcaagctggttgaacaggaacaagccgagcgtgacgagccccatgtgcgcaatcgtcgagtacgccagcaaggcgctcagttccgtctggaccaatgcgatgaggctcgcatagatgacggtaaacaacgatagcgcgatcattgccggcgcgagcatgcggctcgcgtccggggcaatcggcagcatgaacctcaggaacccgtatccgccgatcttgaccatccccagcatgattgccgcgccgatcggcccctccgcgtaggcgtctttcagccagccgtggaccggccacatcggcagcttcaccgcgaaggcggcgagaaacccgcagaaaatcagcagctgcggcacgagatcgagcttcatctcatgccagacgtgcatgtcgaaagtatgcgagaggccgaatagatacagcatcgcggccagcagcagaagcgagcccgcgaaggacatgaagaagaacttcacggccgcgtacgaacggtgcttgccgccccacgccccgatcaggagatacagcggaatcagcgtcgattcgaaaaacacgaagaacagcatcccgtcgagcgacacgaacacgccgaccatcaatccggagaggatcagcaccgcgccgaaatactgggcgacgcgtgtcgtaacggcctgccatgatgcgcccacgatcaacagcgtcgtgagcgcggtcaatacgaccatccagagcgacacaccatccacgcccactcgccagctcatcccgagcgttgccagccagggccggttctccacgaactgcatcgccggcgcttgcgtatcgaattcaaaaagcagcggcatcgtggccacaagcccggccagtgcgcccacgagcgccagcatgcgcgtcagcgtcgggcggccatccgatcccgcgcaacgaacggcgacgccaaataacactggcgtccatacggataaggtaacaaaggggattgaatgcatacggtacgcgtgtgtgcgaaatcggttatttttgttcagatagtattccgaagttatcgaccgccatcacttcccggcgcccttgcttccaaaccctatctcctccggatcattctgaatgtccggccgacagccggcggtcgaccggaaggctccggacgccggggcctgcggttccggacacgatcatcgcgtccggaaccgaatggagcgagccaatcccgaagtgatcagccgagctcgttcacgagctccggcacgagcgcgaacagatcgccgacgaggccgtagtcggccacgctgaagatcggcgcttccggatccttgttgatcgcgacgatcaccttcgaatccttcataccggccagatgctggatcgcacccgagatgccgaccgcgatgtacagctgcggtgcgacgatcttgccggtctggccgacctggtagtcgttcggcacgtagccggcgtcgactgccgcgcgcgatgcaccgagtgccgccgacagcttgtccgccagcggctccagcaccttcgtgtagttctcgccgctgcccagaccacggccgcccgacacgatgatcttcgcgctggtgagttccggacggtccagcttcgtcacttcacggctgacgaactgcgacttgcctgcatcggccgccgcctcgatcttctcgaccgacgcgctgccgccttccgctgccaccggatcgaaaccggtcgcacgcaccgtgatgaccttgatcgggtcgctcgactgcaccgtcgcgatcgcgttgcccgcgtagatcgggcgctcgaacgtgtcggcactgtcaaccgccgtgatgtcggagatctgcgcgacgtccagcttcgcggcgatacgcggcgcgatgtttttgccgtaagccgtcgccggcgcgaggatgtgcgagtagtccttcgcgatgttcagcgcggtcgcttcgacgttttccgcgagacctgcttcgagttgcggcgcatcggccagcaacaccttcgacacacctgcgatcttcgcagctgcatcggccgcgccttgcgcattgtggcctgcgaccagcacgtgaatgtcaccgccgatcttcgctgccgccgccaccgtgttcagcgtcgcggccttgatcgacgcgttgtcgtgttctgcaatcaccagaatcgtcatttctttccgctccctcttacagcaccttggcttcggtcttcagcttctcgaccagcgtcttcacgtccggcaccttcacgccggctgcgcgcttcggcggctcggccaccttcagcgtcttcagacgcggcgcgacgtccacgccgaggtcttccggcttcaccgtttccagcggcttcttcttcgccttcatgatgttcggcagcgtcacgtagcgcggctcgttcaggcgcaggtcggtcgtcacgaccgccggcagcgtcagcgacagcgtttccgcgccgccgtcgacttcgcgtgcaaccgttgccttgccgtccgcgatcgtgaccttcgatgcgaacgtcgcttgcggcaggccggccagcgcggccagcatctggcccgtctggttcgagtcgtcgtcgatcgcctgcttgccgaggatcaccagctgcggctgttccttgtcgaccagcgccttcaggatcttcgcgacggccagcggctcgacgctgtcgttcgattcgacgaggatcgcgcgatccgcgccgatcgccagcgccgtgcgcagcgtttcctgcgcttgcgtgacgcccaccgacaccgcgatcacttcggtcgcgacgcccgcttccttcaggcgcaccgcttcttccaccgcgatttcgtcgaacgggttcatcgacatcttcacgttcgcgatgtcgacgcccgtgttgtccgacttcacgccgactttgacgttcgcgtcaacgactctctttactgcaacaaaaatcttcaaggcattctcctgaatatcaacaccaccacattcaccaggggcatcgggaagacaaacctggactacgcggccccgccacctttacgatttgacatggatgcgtgttaccgctccatgcggcgcttgtctatgcgctcgcgaagaacatcgaccagcaccgggtagccgctcatgtcatccagtcccactggcgcgttgcgttacatgttcgggtaattcggcccgccaccgccttccggcgtcacccacacgatgttctgcgtcgggtccttgatgtcgcaggtcttgcagtgcacgcagttctgcgcgttgatcacgaggcgatcgctgccgtcgtcgttcttcacgaactcgtacaccgctgccgggcagaaacgtccttccggccccgcatacgtgcgcaggttcacgttcaccggcacgttcgcatccttcagcgtcaggtgcgccggctggttctcttcatggttcgtgttcgagatgaacaccgacgacagccggtcgaacgtcagcttgccgtccggtttcgggtactcgatcggctcgcactgcgacgccggcttcagcatctcgtggtccgcatgcttgtggtgcagcgtccacggcacgttgccgcccatcaccttctgctcgagcccgaccatcagcgtaccgaggtacagccccttggccatccactgcttgaagttgcgcgcgcggtacagctccgtgtacagccacgattgcttgaacgcatccgggtacgcgttgagctcgtccgactggcggcccgcctgcaccgcgtcgaacgcggcgtcggcggccagcatgccggtcttgatcgccgcgtggctgcccttgatccgcgatgcgttcaggaagcccgcgtcgtcgccgatcagcgcaccgcccgggaacactgtcttcggcagcgacagcagcccgcccgccgtgatcgcgcgcgcgccgtacgacacgcgcttgccgccttcgaggaatgcgcggatcgacgggtgcgtcttgtagcgctggaattcctcgaacggcgacaggtacgggttcgtgtagccgaggcccaccacgaagccgaccacgacctggttgttgtccatgtggtacaggaacgagccgccgtaggtgtccgacttcagcggccagccggccgtgtggattacgaggcccggcttgtgcttcgcgggatcgatttcccagctccttgatgccgatcccgtaagcctgcggatcggcgttcgcgtcgagcttgaacttcgagatcagctggcggccgaggtggccgcggcagccttcggcgaacagcgtgtacttcgcgtgcagttccatgccgagctggaagttctcggtcggctcgccgtccttgcccacgcccatgttgccggtggcgacgcctttcacggagccgtcgtcgttgtagagaatctccgcagcggggaaacccgggaagatctcgacgcccagcgcctcggcctgctggcccagccagcgcgtgacgttgcccagcgaaatcacgtagttgccgtggttctggaagttggcgggcagcgcccagttcggcgtggtgaccgcgcttttctcggacaggaacaggaagcggtcttccgtcacctcgacgtcgagcggcgcgccgcgttccttccagtcggggaacagttcggtgatcgcgcgcgggtccatcaccgcacccgacaggatgtgcgcgccgatctcggaacctttctcgagcacgcacacgccgatctcggtgcctttctcggcggccagctgcttgagccggatcgccgccgacagcccggcggggccgccgccgacgatcacgacgtcgtattccatcgattcgcgcgggccgtactgctgaacgagttcggccgtacggtgcgtaccacgatctatcgcttccatgatggtgcccagttcagaactggtcttccgacagggccaggatgccttcccgcccttcacgctgacgatcgatgcgctcaaccccagcgcctgcggcaggatgaattccgcgaagcactgcgcagtcgcgatcttggcgccgtagaacgacgggtcctccgcctgcttgtgcgacgcgaccagcattgcacgcgccatctgccacccgctcagcacgatgccggccagcttcagatacgacacactaccggcgaacacgccattgggatcgcgcttcgtattcgcgacgacatgctcgaccgccgtcttcagtgcctgcgcgcccgcctcgagatgtcgacgcatcgattcgaacggcgcgccttgcacggccgcaagcgcgtcgatggtcttgccgatctcggcgagcagggccgaggccaccgcgccgccgtcgcgcaccgtcttgcgacccacgaggtcgttcgcctggatcgccgtcgtgccttcgtagatggtcaggatgcgcgcgtcgcggtagtactgcgccgcgcccgtttcctcgatgaaacccatcccgccatgcacctgcacgcccaggctcgtcgcttccagcgatgcctcggtactccagcccttgacgatcggcaccaggaattcgtaaatctcctcgttccgcgcgcgcgtcgcttcgtcggggtggccgtgcgcgagatcgctatgtgcggccgccacatacgccagtgcccgtgcgccttccgtcagcgcacgcatcgtgccgagcatgcggcgcacgtccgggtgatgaatgatcgtgaccgactccttggccgacccgtccaccgggcggctctgcacgcgctccttcgcatactccactgcctgctgataggcgcggtcggagataccgatgccctgcatgccgaccgagaaccgcgccgcgttcatcatgatgaacatgtattcgaggccgcgattctcttcgccgaccaggtagccgatcgcgccgccgttatcgccgtactgcagcaccgccgtcgggctcgccttgatcccgagcttgtgctcgatcgacacgcagtgcacgtcgttgcgttcgccgagcgagccgtcgtcgttgaccaggaacttcggcacgatgaacagcgaaatgcccttcacgccttccggcgcgttcggcgtgcgcgccagcaccaggtggacgatgttgtccgccatgtcgtgctcgccccacgtgatgaagatcttcgtgccgaacaccttgtacgtgccgtcgccctgcggctccgcacgcgaacgcaccagcgcgagatccgagcccgcttgcggctcggtcaggttcatcgtgccggtccattcgcccgagatcagcttcggcagatagcgttgcttctgctcgtcggtgccggccgtcagcagcgcctcgatcgcgccgtcggtgagcagcgggcacagagcaaaggcgaggttcgacgcatccagcatctcggcacacggcgtcgcgagcagcttcggcaggccttggccaccgaattcgaccggatgcttcacaccttgccagccgcctgccgtgaattggcggaacgcgtcggcgaagcccggcgatgccgtcacggcgccgtccttccaggtcgtcccgttccggtcgcccgacacgttgagcggcgccacgacttcgccgcagaatttcgcggactcctcaatgacggcttgcgcagtttcagcggttgcatcttcgaagccaggcagcgtggcgatctgctccaggttcgccagttcgttgatcgcaaagaggatgtctttgaccggggcgatatagctcatcgcacatctccacattgtgtgatgcgtgcaacaacacgcgggaagacgcgctatgggtcgagcgcgtctgattgatgcgctcatcctagtctcggccccggcttatccggatacccaaacctgcccattgactgacaaaacacgccaaatcaatgcgattcgtcaaacctgcgcacaggttgacgcgatttgtcacttccgagaccgattcagtcactgccggcggcccttccggatgcggataccgggtacggcgaacgcgctccgtcggtcagccgtcgccggcacatccgcacgttgagccgattcgactgccatgcgatggagaaggaatggagaaacgggcgcgaggcaatcgcggcaaagcgcgtcgcgcccggcggccgcgacgcgttgccgcgcagcacggcaactggcgtggagtgctacaagccttgcggccggtggccgcacgcggcacggtcatccgcgcgcgttcgcggccaggccggccgcgtgatatgacaattgatgcctcgatttgccggcggttcgacgaagacctcgccgcgcgtcgagccgctacgcgcgtgcgccccgcagtttcagcgcgatctcgagccgagcgatccaggcggcgtcgtcgagtttcgcaccggtaatgttttccacacgttcgagccgatggtcgagcgtgttcgggtggatatccagcgcggcggccgtcaccttgcggcgttgccggttcgcaaagaacgtctccagcgtcgcaatgatttccggctccccgccagttcatcgatcaacgacagcaggtagttcagcgcgccatcattgccgcgcacgcactcctcgaggacgatgtccgagtagcgatgcgcgcgatgccctgcatttgcgctccggccgaacgccagcgcgcgaatcgcctcctccgcggacgccgcccagcctttcgccccggtgctcgccagcccgatgccggccgatgcgtcggacgacgcgctgtcgagccatgcagccacgctgcccgcgacccgcctgtcgctcgcgctggcggattcgtcgtggaggcacggcgcccatacgatcagccggtcccgatgccagacgtcgagcaggctgtcccggggcgttttcaggtgacgtgcgacggcgagcaccagtcggtcggtctcctcctccgcgtgcagcgcactgcggtccaggtgcgccgattcgatcgcgatcgcgattcggcgcatcgtgggatcgagccccagcgccttggtggccttgcggaatgcgtcgtcgtcgaccgtggggttgaagatgatttcatgcagttgatagcgcagcgactccttccagcgcgcctgctgatactgctcgtcgagataggcacgcgacatcagctgcgccatctcgtcgaagaaatccatcaggtacggcgagatcacgaagaacagctcgtcgcgcaactcgtcgcatgcgctgccgagttcggcgcaactacgccacacctcctcaccccgacgcgaaacgcgcgcagcagcgacggcagcggaatgccctggtggacgcgccgtcggccgcattcctggaacacctcgagatccttgtccgacggaaacgcgccggtaaatacggactcgaaccacagtcgctccgataacgcgatcgactccatgatgtcctgcctgaccgcggctgacagatcctcgtagccctcgatgcgaatcagggccgcataggtccgatcgatcacgtctgtcggattcagcgtcaattcccgaatcttgtcgcgcatcagcgccgacgtttccggaatttggacatgtcctgtatgcatctttcctcttctttcggttcggcggcgctcggccgccatcacgcgcacccaggggcaatcgggtcggcgccacgcgccgaacgacacccgtcgcccgacggggcgttgtgaaaagttccattcggaacgcccagttctcccatttcgccgccctggggcgaccggataacgttcacagcaagtcgatcggacattgcgtccgattgacggatatgtccccgtgtcactcgccagaggccccatgcaaaccccgagagtatattttccggcctgaaggtcgtcgatttcgccagctacattgccggaccggcagcgacgacgattctttcagatttcggcgccacggtcatcaaagtggagccgcccggcacgggcgacccctatcggcatttctatgcgatcccgccgaacccgatcagcgaacacaactacgcgtggcaactgaccaaccgcaacaagcgcggcctcgccctcgacctcaagtcgcccgccgctcgcgacatcgtcacccgcctcgcccaatgggcggacgtcatcgtcgtcaacttcccgccgaagatcaaggaaaagctcggcctcacctatgaggcgctcgcgccgctcaacgagcgcctcgtctacgccgacctcaccggctacggcacgaaaggcccggaagccgacaagcccggcttcgacatcaccgcctactgggcgcgcaccggcctgatgcaggtcacgcgcgacggcgacagcccgccgacactgccggtgccgggcatcggcgatcacgcgaccgcgagcacgctgtattccgcgatcgtgacaggcctttatcgacgcgaaaaaccggcaagggcagccacgtcagcacctcgctgatcgccgaaggcgcatgggcagccgccgcgtggatcgaaggcgggctcaacggcgcgcgctatcgcgagcggcagggccgcaagtcgccgccgaacgcgctgctgaacccgtaccgcaccgccgacgatcggtggctcctggtcgtgctgccggcgagcaaggactggccgctgctcgtcaacgcaatgcagttgcccgcgctgctcgacgatccgcgcttcgccaacgaggcagcccgagcggaaaacgcggccgcactcgtcgcgattctcgacgaagcgtttgcccggcaaccgctcgagtactggaagaagaccttcgacgcaggccgcgtgatctacggcgtcgtccagatcgcggacgaaatcatcaacgaccggcaaatgtacgagaacgacatcttcgtgccgctcgccgagccgaccggcagcgcgacgcacacggtgaacagccccgtccaggtcgcgggtgtgcagaaggtctcgcccgggcccgcgccgcagctcggcgaacacagcgacagcgtgcttgccgacctcggttacggcgccgacgaaatcgcccggctgctggccgaaggcgtcgtatcgaagcacggcacgcgcgcatgacgcgccagccgtccgattccccctcgaattgaaaggacaacaaagtgaccgaacaggaattgcttgaacaggcctatgcgatgccgctcgtcggcccggcctacgcgaagccgccgtatcgcttcgtcgatcgcgaattcatcatcatcacgtatcggaccgatcccgccgcgctcgagcggctcgttcccgcgccgctgaagatcgtcgaaccgatcgtgaaatacgaattcatcaagatgccggactcgtcggggctcggctcctacaccgaatcgggccaggtcatcccggtaacgctcgacggcgtcgcgggcggctacacccatgcgatgtacctcgacaacctgcctggcattgcggcgggacgcgagctcctcggttttccgaagaccctcgcccagccgaagctcgaggtgcgcagcgatacgctcgtcggcacgctcgactacaacggcgtgcgcgtcgcgacggccacgatgggctacaagtatcaggcgctcgacacggaagaagtccgccgttcgctcgacggccccggctacctgctgaagatcattccgcacgtcgacggcaagccgcgcatctgcgagctggtcaagtaccggctgagcgacctggtcgtcaagggcgcatggacgggccccgccacgctcgaactgcatccgcactgctttgcgcccgtcgcgcagttgccggtgctcgaagtgctctcggcgacgcacatcctcacggatctcaccctgggtgcgggcgaagtcgtgcacgactacctggcgccgtcgcgtcatgaccatcgattccgttgatgccgcgacccgcgtcatcaagaacgactctggagagttgaagatgtcgaagcaaatcaagcgtgttgccgtgatcggcaccggcgtgatcggcgcgagctggaccgcgctgtttctcgcgaagggcctggacgtcgtcgccaccgacattgcgccggatgccgaagccaggctccgtcagtacgtcgacaacgcatggccggccctcgaaaagttcggtctcgccccggcgcgtcgcgcgaccggctgacgttcaccgccgatacgcggaccgccatcgccggcgcggacctcgtccaggaaaacggcccggagcggattgccgtcaagcaggcgctttattcgctgctggacgaaacgctgcccgccgacgtgatcatcgcgtcgagctcttccggcctgacgatgagcgagatccagtcggcctgcgagcgccatcccgagcgctgcgtgatcggccatccgttcaatccgccgcacctgatcccgctcgtcgagatcgtcggcggcaagcagacctcgcaggacaccatcgaacgcacgatcgcgttctatacgagcctcggcaagaaaaccatccggctcaacaaggaagtgcccggccatgtcgcgaaccgcctgcaggccgcgctctggcgcgagatcgtccacctggtcgccacggacgtcgtgagcgtcgaggatgccgataccgcggtgtgctggggaccaggcctgcgctggggtgtgatgggcccgaacatgctgttccatctcggcggcggccagggcggcatcgaacacttcttcgaccagttcaccggcccgatgaccgcgtggtgggaagtgctcggctcgccgcagatcacggcggcagtacggcagaaaatgaccgccggtgttcgggaagaagttgccggccggtcgatcgaccaactggccgcccgccgcgatgaagtgctgctcggcctgctcgcgctgcgctccgaagaacgctgatgcatccgacggccgccgcgcagatcgccgcggcctctttcccctcgatcatccccctcatgcaacctcttctgaatctgtcatacgaaaagcgcgcgggcatcgcatacgtcaccgtgaaccgtccgaagtcgctcaacgcgctgaaccatgcgacgctcgacgaaatccgcgcggtcatggaagacgcgcgcgacgattccgccattcacggcgtgatcctgacgggcgccggcgacaaggcgttcgttgccggcgcggacatcagcgaaatcgcgccgctcggcgccatcgatgccgcgacgttcacgcgtcagggacaaaccacgttcgatctgatcgaaaacctgggcaagccggtcatcgcggcgatcaacggctttgcgctcggtggcggctgcgagcttgcgatggcctgcacgatccgtctggcgacggaacgtgcgcacttcgggcaaccggaagtgaagctcggtgtcatcccgggttcggcggcacgcaacgcctgccgcgcctgatcggcaagggccgcgcaatgcagttgatcctcaccgcgaccatgatcgacgctgccgaagcctacaggatcggcctcgtcaacgaggtggtgccggccgatgcgctcctcgcgcgcgccgaagcgctgctcgcgcagatcgtcgccaacgcgccgctcgcgacccgattcgcgattcaggccatcaaccgcgggctcgacatgagccaggaccagggcatgctgctggaaagcgcactgttctcgatctgcgcggcaaccgacgacaaacgagaagggacgtcggcgttcctcgaaaagcgggtcgccagcttcaccgcccgctgacgctacccgggcggcacggcgttcgcgctccgggcgcctgcgccgtcaccggccgacggatcgctcggtatggcgatacgcggccggcgtactgcccgtccagtgacggaacgcgcgatgaaatgcagtcgggttgtcgaacccgacgtcgtatgcaatgcccgcgatcgtctcgttggagtgagtcagccgctgaatcgcgatgtcgcgccgcacttcgtccttgatggcctgaaacgtcgtgccttcgacttccagacgccggccgagcgtacgcgtcgaataattcagcgcgtgcgcgacctgatcgatcgtcggtgtcgcgggcaggcaatccgccatgtaacgccagacctggtggcacaccatctggtccgcaaacgtgacaaatatccagtcttcgggcgcccgcttcaggaacgcctgaagatccggcttgcgctgcctgatgggcatcgcgagatagttcgcatcgaagcgaagacaggtcatggcttgatcgaacttcaccgggcctggaaacaggtaaagatgatcgcccgcctgtgccgagcgcggaaactggaaattcacctcgatcagcggaatcttctggcgaatcagccaggatgcgatgccatgaatcagcttcagcaccagttcgcatccgagcgcgctcacgcccgggccttgaggctcgatgatcaatcgaaccatgccggccttgccgtcctgcgtggattcgagtgtgaattcttcgaggaggatatgaaagaactgcgtgagccgatatagcgcgacttcgagccgcggcgcgtcaagcaagctcagacagagaaatttgagcgtgccctttctcaaccgtcggctgaaaatgcccggcatttcgtcgtccagttcaccggccagcagacgatagagcgtggagaattgctcctgcgtcacacgggcccctggcttgccgagcaactcgtgcggaatgcccgacagctcggccagtctggcaatcgtctcccgctcggcgccggaaaggaagccgttcacgacggtaatgggaacggtggcggtcagtggattcaagtcggctacccgcaatgtcgaaggaaggccatgctgtcgtacgcgcggctcacagcgcgcccgcgtaccgcgcatctgcaccggcatccgcgtcttccgcaagtcttgccggctcgacgtcggcacccggcccggcatacgctgcaaacgtctgctcgtcgcgtgccagcatcgacggcaccgcgtcgcgcatcaaatcgacccaagtccggattttcgcatccagatactggcgcgacgagtacagcacgtacacattcatgtcgtgggtgcgatagtgcggcagcacgcatgtgagctgcccatcgcgcaacccgtcgaccgccgagtaaagcggcagcagaccgatgcccatgccgccccgaatgcctgccgccagcgcgtcggcatcgttgacgcgaaaggcgggcgtgaccggcgcggtcgcctgtacaccgtccgggccgatcaggttccatgcgtcgtgcgatgtcgacgtcgtcatcaggccgagacacgcgtgccgttcgagatcctggagcgtggccggcacaccgtgtgtgtcgacatatccgcgcgacgcgcacaggatgccgaaggtcgctccgattcgctcggaaacctggccggattccggcggatggcgttcgagtgagatcgacacgtccaggccctccccgatcaggtcgggccgccgcccggtcgtcagcaagtcgatcctgacctccggaaaacgctgccgataggctgcgacgagcgacatcacatagcgccggtccaacccgttcgcgcaatgcagcttcagctttccggacggccgcgcatgggcgccgcacgtctccgcctcagcctgttcgaggtaggccagaatttggtcgcatcgccgccagtatcgttcgcctgcgtcggtcaacgagacgcggcgcgtcgtccggttcagcaaacggaccgtcaggtgccgttcgagatccgacaccacgcgggaaacccgggtagtgctcacgccgaattgccgggccgccgccgaaaatccgccggcgttgaccacgccaacgaacaggcgcatgtgttgaagcgtgaccatggtttcttccgttttggacaaacggaatttttgcacgggaatcctgatcgattgcccgcgacgttcgcaaaattgcgttacgcagggctttgtcgttttgcacaaatccggttgtgcgaaagcgctcgacgcccagtaccgccttctcgaaccgtgccggcaaagccgtccccgacgccccttcggttaccgcgtgtccgactgcgccttgagaatcgcctgcgcccggttcttgacgtccagtttcagataaagattcttcagatgaaacttcaccgtgttctcggacaggaacagcttctcggagatctcgcgattcgacgctccgctgcacagcaaccgcaggatttcatcctcccgctgcgacaacatgctcgaccacgccgccttctggacgttcgccttcggaagcggctcggcccgctccgtgccatcgagcatcgccgccaactcgccgccctcgtcgagcaacgcacgcgtacagccgcccgctcgtgcggcgtcctgcgcactctgcaacgtgcgcagcgccagccgcgtgtgcccttgccgatgctgcaccagcgcctgcagtacctgcagcttgacagacagcagcggtcgcgccggcacgatgccgagcgccgccttcagcaactcggcggcccggtcgagccgctgctgctgcaacgcgagccggatgcggccgagcaaagggccgctcagcagttccgtcacctcgatccaccccgggtccggcgcggcggtatcgcccgatacctgcgacagcaacgcatcgatgcgtgtcgtctcgccgctgcgcgccgccagatacaggcgctcccacgcaatcatctcccgcacgctcgaccagcgattgtgaaagctcagacgctcgagcgtgtcgagcgcgtcgcgcgcctgaagcatccggccgcgcgcgacatgcacgcgcgcgatcgacaccatcgacaacgcgatgaattcaggcaccgtcgcgagcgcaatatcctcgccgaactgcgcggagagtcgctcgaccgtgtcgaactggtctgcctcgtagcaggcccagatgcgcgacgccgccagcgccgcggccgacatgccccggttcacgtacggactgcccgcgtcgcgtcgcatgccgcgagtcgcatgcggggcatcggtagccagccgcggctgcgcgctcatcacctgcaggatgcagcgcaacgcgagcgtatagccatggctgaacgcggcctgtgcatggtcgttgtggctgtttgccagcaccaggaggtgatgggcccgttcgtcgtcccactcggccatcgcgctgaacgcaaggagattggccgccgcgccgagctcgaacgcctcgaacaggccggacgccggctgacgcagcgcgggcacgtcggcgagccgcgccgcgccgcgcaggtcgttcccgaacagcaaggccatcgcgagcacgacgtcggcgccgtgcccgtcgcgcgtatcggcgagatacgacagcagcggatgggtcggcccgccgcgccgcaggaacaccagcgcccacgcgatcttcaccgcgaggctccggcagccgagcacctcctgcaacggcagccggtcgaaccagtacgcgaccgtcaccaactcggcgccctcgacgagtcgggacgcccagtcgtccagcgtcgtgatcgcgagcgaatactcccgtgcctcgaccgcatggaacatcgcctcttccggcacgccatggcgcacgtaccagtgcgcggcgcggcggtgcacgtcgatcatgtgcgccgcatcctcatgcgcgagccgatcggacaggaagcgcgcgaacagcccgtgatagcgataccatcccgggctgccgtcgagcgcctccacgaacaacccgtcgcgctcgagctgccgcagcaccgcgtccgcgtgctcgaacccggtcacttcccgcagagcgagccgttcaggcgccgcaattgcgacgtcttcagcaggaacgtccgcacggcgggcggctgtagcgccagcgtattctccgacaggtagcgaaccagctcgagcggcgtgcagtcgcgcatctcgtcaagcgcgtcccggatctcgtcgcgcgcgagcgcgagcttgaacagttgcagccccgcgggccatccctcggtacgcgactggatgaacgcctccgtttccgcatcgatcgtgtcggcggcatccgcgaggaacacggccgcttcgtccgtcgagaaacgcagatcctccatccgcagcacgagcgcctcttcggcaacctgcaacgcgctcacgccgacgtccggcaggttgcgagatccgatgtagacgcgacagcgcccgggcagcgcgtccagcagatcgcgaaagaaatgcagaatcgccggctcgtgaatccactggaaatcgtcgatgcagatgccgatcgggccgtcgacccgtgcgagctggccgaacacccagtcgagcatgttgtcggacgggcgcaccgcctgcccgctcgcggccacgccggcctcctcgaccatctgtgcgatcagcgagatgaaatacgcttcgaaacggcgtggatcgttgtcgttctcgtcgagcgcgagccacgccatcgtccagcgcttcgcgcgccctgcctccatgatctgctgcagcaacgtcgatttgccgctgccgagcggggcctgcaggatcacgatgtgcggcacgccgagccccgtcacgcgatcgagcagcgcacgccggacgatcgcgccgcgacgcgcgaccggcggaaagaacttgtgttcgagcaggtccgcgccgtggcggcgtggcctgcgtcgcgtcgaattcagggaagcagtcacgatcgtccggatggcgtggaagagaaggcatcgtgcctcaatcgtaaagccgcttcaagcatcgccggccgtcggctccgccgcacgttcgtccggcagcggcggcgtccagccgccgacgcgcgaaaatgccgagaacgccgcgaacggattgcagcagaacgggcgcaggcagctttcatcgtgcgacgccccgtcgtccaggccatcggcccccgccgcccgcgcgccggttacgagcgacgccgtcatcgcggcaccgcgccggcaaaagccacgtatgcgtcgagcgccgccggattggccatcgcatcgcgactcgccgcgctctcggcgcgctgccccatcaggatcttgcgcaccggcacctccattttcttgccggtcagcgtgtacggaatctgctccatcgcgaccatcacgtccggcacgtggcgcgggctgcacagcgtgcgcagccgctccgcgatccgtgcgcgcagcgtatcgtcgagcgccgcgccatcgcgcaggcgcaggaacagcggcatgaagtagcggccgccgggcagttcgcagcagacgacgaggctgtcggccaccacttcgatctcctcgacgacgcgatagatctccgccgaaccgatgcgcacgccgtggcgattgagcgtggaatcggcccgcccatagatgtagcaaccgccgtgcggcacgatcttcatgaaatcgccgtgccgccacacgccgggaaatagtcgaaataggactcccgataacgcgtgccgccgtcgtcgttccagaagcagatcggcatggagggcgccggccgcgtgacgacgagctcgccgatttcgtcgacgaccggctcgccggcatcgttccacacgtcgaccgccatgccgagcatgcgcgcctggatctctcccgcccgcaccggcagcagcggcacggcaccgacgagcccgctgcacagctcggtgccgccggattgagacgtgacccacaaatccggtttcacgcagcgatagaaccacgagaacgtttccggcgtgctcggcgcaccgctcaggatcacgctcctgacgcgcgagaggtcgaattcgcggccgggctcgaggccggccttctccatcatctgcacgaaagtcgggctgccgccgaagcaggtcgcccccgcatcggcggcgagctgccacaggcaacccggcccgccgtgcatcgggctgccgtcgtagagcaccgcggccgcgcccgtcatcagcgacgcgaccagcaggttccacatcatccagccggtcgtgctgtagaagaacatcacgtcgccggcgcgcagatccatgtgcaggtgcatcagcttcaggtgctcgacgaggatgccgacgtggctgtggacgatcgccttcggcaaaccggtcgttcccgacgagaacacgatccagagcggatgatcgggaccgacacgttcgaagcgaaatgcgtcgggcggcacgtcggggccatccagaagcgcatgccacggatgcgtcgcacacggcagtgtcgcggcgccgtccggcagcgcatcgacgtcggacgacaaccacacgagcgcctccagcgacggcagcgcgtgcgcgatctgcaacgcttcctccgtgcgctcgaacacccgtccgccgaagctgtagcgatcggccgcgatcagcaccttcggcgcgatctgccggaagcggtcgaccaccgtacgcacaccgaaatcgatcgcggccgacgaccatactgccccgatgctggtggctgcgagcatcgcgatcgcgcattcgggcacgttcggcaaatacgcgacgacgcggtcgccgggctgcacgcccatctcgcgcaagcgcgtcgcgacgcgccgcacccggccggcgagctcgaccagcgacagcgtacgcagcggttgcgtttcgctcgcgtagtggaacgccggctgcgcggcgtccgcatgcgcggcatgctgcagcacgtgttccgcgtagttcacgcgtgcatcgggaaaccagcgcgtgtgcggcatcggcgcgccgtcggtcacgcgacgcgccgatccgtcgaactgcacgtcgaaccactgccagatcgacgcccagaacgcgtccggttcgccggtcgaccagcgccacagcgcatcgtagtcggcaaacgccaggtcgcgatcggccgcgagccagtccatgaaacgcgccagattggaaccgcgcatgaacgcgtcgtccggcgtccacatcagttcgccctcgttcgtcatgtcaatgcctttcacgtaagcgcgcaatgcgcgcgagaaccgtttcgggatgcgccagggcggggatttccgcgacgtcgaacgtgtcgggccgcgccgccggcaaatcgtcttcgccaaaccagaacgccgcgggcacgacaacgccggtcggccccgggccgcacgtcgccggcgcgatcgcaaagtccggcgccgacgcgcccgtaaaggcgaccgacgccggaatccgcagccccattcccagccataatgccgcgcgacgttcgcgaccggctgaagcagcgccagcccgtgcgcggcaccgtcggcatcccatccgagcgaatcgcgcatcagcacggcgtccactccggccgtcgcgaacgtgcgcaggaaatccgccacgcacgccgctgccgcgtcggctgcgtcttcgtcgacttcgacgcgctgcgtgccgctcgcgaacgcgaatgcgcgcgccgcccagtcgcgcggcgacggcagctccagcacgaagatcgcgtcgggcaacgcggcgcgcagcgcgaccgccagcgccgccacatgcgcacgcaccggctcgcttgaaagatacgctttcagcggcagatgcgcgcgcttcgtcttgccgatcagctcggcggcaagcgccgagtcgcgcgtgagccacgcgtcggccacatccgcgagcggcagcgtgagcacgtccgggcgcagcaggccctgcgcgtgccgcgcccacgcgacgcacgcggcgctgtcgagccacggtggcgcgtcacccgtgagcagcggcgcgctatagccggcgtgatcgagccacagcagtcgacgcacgcggctggcttgcgtcaatccgggcatgatgacgcccccgcgttcaatgcgtcgagacgcgcttccagttccgcgattcgcacgtccttcggatcgagcatgtacgcgccctgaagccggtcggccggcatcgtgacgcgctggcccagcgtcgtcgcgtagatctccgcgttgtcgctccagctgccgaagtagggcaacgaagcaggcggctctggcgtcacccattccgcgcagaacgcatcgaacggccgggcacgggcaatacgcgcaagccgctcggcagcccgtgcgtcggcggtcgcctcgacgtccacgaccagcgtctgctcgtcgtagacgaccttgtagatgtcgcgtgcattctcgtgcgacatcagttcctcgcgcagatccttcatcacgagcgccggatcccgttcgagcacgtcgccgtagccgccgcccgagccctggcagatcatgtagatctcgccttcgttgcagatctcgaacgtcatgcccatgtcgtggctgctgtacttcgccccggaatcgggcggttgttcatcaggtcgacgatgtcgaacgtttcgacggctttcggattttcctccagcaccttgaagatgttgatgcccttgatcttcatcagctgatagctcgggcacgaatagccgccgaacaggccctgcgcggacgggaacttcgaccctcgcatccggtcatgaagccccacaggcccgacccgcgcgcggtcgcgatctgctcgtagcccatcccgccgcgatacttgccccagccgatccggtccttcgcgagccgctgcgcgccgaggcggatgatcggcgtatcctcttcggcgatctcgtgctcgccggtgtcgcacatgaagccgaacacgggcgagatcgagtgctcgccgtccgcgtggctgcgcgcgccctgcccgttgccgttgatgtccgcgcagaagttgccggtcacgtcgccgtgttgcgtgaggccgccgtagatgaacgtcgctgcctgatcgtattgcgacgcgatcaccgcggagtagcgatgcggcaggctgtagctgagcttgttcatcgggatcgtccagaccacgcagcccttgaacagcggcatcaggctcatcgcctgcggcatctcgccctctgcgtcgaggatcgagttgcgatcggtgatgatctcgatcggcgacagcacggccatcgtgtgcggcagatccggccagatgttctgcaacagcccggtacacagcgccgccttgaacgaggcgatgttggtgttcaccgagcggttcatgaactgcggggccgagccgcgaaaatccatgatcatccggtcgcccttcacggtgatcgcacaggagattttctgcagcgcattctcgcgcaggctcgaatccatgaactgcagcacgcgtcgtgccgtcgggcagctcgcgaatccgccggcgcatctccgtctcgacgtcttccagatgcgagcgcagcgtgccgatcagcgcatcgcggccatactggtcgagcaacgcgatgatccggtcgcgcagccgcagcaccgcatgcagcttgaccttcatgtcttcgagctgcagccgcggatcgcgcaccgagttctgcaggaacgtgacgagatcgcgcttcagctcgaagttctcgacgatcttgaacggcggcatcttgatgccttcgtcgtacttgctctccgccttggccggcaagccgcccggctcggtcgagccgttttcgccctcgtggatcgtcgacgacagccagcagacgagttcgcccttgtagaacagcggcatcatcatcgactggtcggtgttgtgaatgccgccataacgcgcgtcgttgtggatgaacccgtcgccgtccttcacgccgacggtcggatcgtcggtccagttcttgatgatgaagcggatcggatagaagcagcacgcggcgaacgcgatgatcccgtgcggcgcgatcatcgacaggtcgccctgcgcggtgtagatcgccgtcacgaggtcgccccacttcgcacccggcgccgccccatctggttcaccatcgtgaacgcctcggacagcgccgagttgatcaagccgcgcacatggtgaacctggtgcggatcgacgccgcgctcgagcacttcctgctcggccttcgagcgcggcaggatgctgtggttgcgcatgatctcgggatccggcccgaggaatagcgtgttgtcggcgatgaacttgtcgagcagcgcccggtcttccgcattgatgtcgttttgcatgtcgaactccttgcttacttgcgcaggaaccacgcgccgccctgggccgtcgcctggtagatccagcccggttcgacgaggaacgtcgtcgcgcgcgtggtgatgacggccggcccttcgatccgcgtacgctcggcgcgcgcgcggtcgtcgtagatcgcggtgcgcagcggcccgtcgtgcccgacgaagtggcagtcgcgatgaccgaccggctccggcggcggcagcggatcgtcgctgaccgtcagcttcgcgaacttcaccgacggctgttcgacgtacgcgcacacgcgcagcgtattgatccgcacgcccgtctcggggctctgggagccctcgccgaagcgcgagccgtagctttcatggaacagctccatcagcgtcagcacgtcacgctggttcttcagcctcgacagcggcgtcaccaccgccgtctgcacgcgctggttgccgtagcgcatgtccagttcgagccgatagcggatctgtgccggatccatgccctgccgttcgagatcctcgcgcccgcgccgctccagttcctcgacgccgcggttgaacgcgtcgaaatccgcgaagaacgctttcgtgttcggattgaacagcacggtccacgtattcatctcgtgaatgtgcatctggttcaccgtgccggcgccgcacgcggagaaggtcgacgaatacggcggggcgaggacgcgaccgatgccgagcgcggccgcgatcccgcacgcgtgcagcgggccgttgccgccgtacgcgagtaccgtgaaatccttcggctcgtagccgcgcgtgcgcagctcggtcgcgatgccgttcgccatcgacgcgtcgacctgcttcttgatcagcttcgcggtctcgatcacgtcgaggtccagctcgtcgcacaggtcgtcctgcatcgcctgtttcgcgcgtcgcgggttcaacggaatgcgaccgttcgcgtagttgttcgggtcgagatagccgagcagcagatcggcatcggtcacggtcggatgctggccgccgcggtcgtagcaggcaggcccgggatcggagccggccgattgcgggccgatctcgacggtcttgtacatgcgctcgtagcgcgcgatcgagccgccgcccgcgcccagcgcgacgagatgcaccatcggcacgctgacgagccagcgatcgatcaccgggttgaagtcgtagaatttctgcccgccccgcacgacgatgccgatgtcgaagctggtgccgcccatgtcggtcgcgaccacgttgccgagctcggcggcggcagccaggtattcgctggcggcgatcccgaaaccggtcccgaatggaccgtctgcagcgcatcggtcgagttcagttgcgccatcccgcccgagttgtgattgaccagcatcggcttcgcgtagccctgctggcgcaggttcagctccagcgtgccgagcccgtgatacatgatctgatgcaggaacgcgtcgatgatcgacgacgtcgctcgcgagtattcgcccttgcgcccgacgacctgatgcgacaacagcatcggaatcgcgccgagcatgtgcgccggatattcgtccaggaaaatttcgcgcacgcgcagttcgtgcaccggattcaccacgctgttcgtgaacatcacgaccagcgcctgcgcaccggcatcgacgagttcgcgaatgcgcaaccgcacgtcgtcctcgtcgagcgtccagaacacctgccccgcatagtcgatgcgttcgcggacttcacggatcagcggaatcgcgacgagcggctccggccgcgcggcattcgggatatccatctgctcgggctcggacagcccttcgccgtaaccacgcgcacgggacaacggaaccgtgtgcttgaaacccgtggtcacgatcaagccgacccgcggccccttgcgctcgatcagcgcattggtgccgagcgtcgtcgcataacgcaccgagtcgacttcggacagaagctgcgtcggcgtcagttcgagctggcggcacgcgtccgcgagcgagtcgttgaagccgaccgcgagattgtgatgcgtggtcagcgacttgccctcgacgcactgctcgccccacgcgacgaagcaatccgtgaaggtgccgccgatgtcgacggaaacacgtttcatgagcgattctcccgtatctcaagtggacgattcatcggcggcaccggcgagcgcatgccgatgatgcgcggccgcatgcagcgcgcgctgcaacttcacgcgctcgagcgcgaggtcgggtgcctgcgcgggctcgatcatctccggccggtccttccattgcgccttcaacgcgtcgatgtcgagttcgatgtcgtgcagcggcggatggcccggcggcagatactcggcctcaaccagaacgccgcactccgggcagtagtactcgagaatccggcaccagtccggatcgggtgaataggtacgctcgtattgcgccggatcgagcagcggcttgtggatctcgcgcgggtcgcgatcgtggacgagcagcccgcgcttgtagttgtcgcgtgcgctaccgtgcgcatgaccacaacgccggcattcccactgctccgcatccaggtcgatgcgcagcgtttcggtaatcagaaccttcattatttgctctccttgccgctgctgagcaggatgtctccggtggagttgatttcgaagtgccagcccgcgtcgatgcgcccggtgaaaaagtcctcctcgagcacggccgggccggccgcatacaccgcgacgcccttcggctggtcttccacgcgatacagcggcagctccgcttcgcggccatcgacaaccaccaggcgcgtgccgcgcgcgatcgctgcctgctggccaccctcgccgaaccggccgtcgagcaccgcctgcggcatacgcttgatcgcggtcagcgtcaccgacagcgtggcgcccggcgcgacgcccggcggcaacgccgggcccggcaacgcgtgttcgactgtcttgccgtcggcgccggtagcctcgagcgtgtagacgagccggcagtcttcgatcgccgcaccttcgccgaacatcgcgcgcgatgcttgcgtgagcagcacgtccatcgtcgcggcgagcgcgtccccggtcgtgtcggccagcggcgccgagaagccatggcccacatccgaaaagccgattccgtatgcggagaacactgccgccagcccgggaatcaacacgcgcttcacgccgatcgcatccgcgacccggcacgcgacgaacgcgcccgcgccgccgaatgcggcgagcgtcgtatcggcgcgaatttccgtgtacgcaacgaggctgtcggcaaccttcttcacccacgcggcttccatcgcggcgagtgcctccttgtcacccatcttcatcggatcggcgacatgcgcatgaatggcctgccgtgcgcgcgccttgtcgaggtgcagcttgccgccgaagaacgacgccggatcaagcaatcccgccagcgcgaacgcatcggtgatcgtcgcccgggtacccccaggccgaagcacgccggccctggcgcgctgccgacgctctccggtccgaccacgatcctgtcgccgtccgcacgaataatcgaactgccgccgacgcccgcgctgaccacgtcgcacagcgcgaacgatgtcgccacgccctcgacgttgccgtaccggttcgcgcgcacgccatgttcatcgacaacgccgatgtcggtcgtcgtgccgccgatatccatcgacaacaggtgtgtcagtccgtagtgcgcggccagcacgcgcgcgccttccatccgccgcgcgggcccgaactgtaggtcttcagcgcgatcgtcttcgcgacgcggcccgcatggccgtcgttgcggaacaccagcaatggactttgcgctcgcgcgtcgcgcagcttctgctcggcgctgtacaggaagcgctccatcgccggatgcaggaatgcgttgaacagcgcggtccacgtgcgtcgcacgtcgtcggcatcgtcggcgacttcgtgcgcatacaggatcggaagcgcaccgagcaggtgcggcggaaaactgcgcagcagccggctcttcagccgctgttcgagctccgcacgccgcgggccgccgatcgccacgaccagccggttcgcgcccgccgccgcgagctcgccgacgatgcgcacgatctccgcttcggacggctcgctgcccagcgaaaccgtgcgctcgccgatcaccgtgtcgaacaggctcgccgcaccgtccgcgtcgcgaacccgatcggccgtcagcgtgccgccgaccaccaggccgagccgcggcccttgcgttcgaccagcgcgttggtaccctgcgtcgtcgaatagcggatcgccgccgttgacagcagcagcgcctcgagatcctcgcgtccgtagattgcttcggatgccttacgcaatccgtcgaacagacattgcgacagatcgtgcggcgtcgtcagcgtcttcgtgcgcaccaccttgtcgctgtccatcacgcaaatgtcggtcagcgtaccgccgttgtcgatgttgatcaggcgatgccgcccaggcccggtacttgccgaacccgaccgcacatcgtgcgtgaaatcggatgagtgagtcatgaactgtctcgctgggtgaaggggcgggtcaggcctggcgaatccgccgcgacggcgggccggcgggaaggtctagcggcgcgggctgtgcggcctggcgaccacgcagcggtgagagaaatgggcaatgcatgtcgtctcctgttgttgtgtctatcgtggaatcagtctaggtgcctgcttgacgcaccacgccacccgtccgggtagtctcgagacatggattgcccgtatgcggtgcatgtgcgtatgcgaccttgtcggacatgcgtgtcgaatcgcgccccggcgccgtcgtgcgcgatgcagtgaagagaacgggagatgcgcggcgtgcacgcgccgcgactacgcctggcacaccgtgccgagtggccggcccggatcaatggcgacgaacgggcaaagcccgttcgccgacatcgcgtcggcgtgacatagggagaggacgccgcgccgaaagtcggcgcggcgattgggaaaacgcagtgcggtacgcggcacatcacgcgcagtcccgacgtggatgcggcccgtcgcaccgaacgggcaggtacagcgtccgccgaagtcgacggcaggatccgagccggtccggacgctgcgcgccgcgttgcggatgcggcgcgtgccggtcagaacaagtgacggatgccgactgccgagccgaacgtcgaacccgacgcaccgaacaacgcgtcgttcgtcgacagaccggtattcatcttcccgtggttgttgacgaagccgaactggccgtacagcagggtcgccttcgacaggctgtaagtcacgccggtcgcagccatgatcgagtggttgcgcgtgtcgttgccgtcgctcgtataccagaccccggcatccgcattcacggcgggcgtgatctgatagctcaggccgccgctgtagacacggttgtcgaacgacccggaaattttgtagccgacgaacgacgccttcaccgtcaggtcgcgatactgatacgtggcgccgatcgtgcgccctaaacggcaccgtgctcggcacgggcgtcgacgcggcggtgccgcccgcgttgccgttgtacatggcggcgctgaccagcagcggtccatacgtatatttgaggctcgccgaatactgccgccccgcctggaagtcgcccgcgacgccaccgagcgcgagcatcgcggcgccctggaacccgccgatcgtcgggctcgtataggacaccgcgttcgaattgaagatgccggtcacgaacacgctaccgacgtagatcggcacgccgctgccgaagtaagacacatcgcgcgcatcggtcgagatgagcgacaacacgaacggcgagaactgcacgccggccttcaccgtcccgtatggactggcgagccccacccacgcctgccggccgaacatgttgccgttcgaatccgtgaagctgcctttcgcgatatcgatcccgctttcgagcgtgaaaatggccttcaccccgccgccgagatcctcggtgcctttcaggccgaacagcgacggcgtcatgccgcccgtcaccatcgaaaactgatggcccgcgttctgcccggtcgcgggattcacggtcttgctcgtatagagaatgccggcatcgacgacgccgtacagcgtgacactgctttgcgcacgggcggccggcatgccgacggcaaggcaaataagaggcgtaacgacgaggttgacggggaaagggcatgcttcatctactacgtctcctggtgtttttcgaagttggaaggccgtgactcgcctgcctgtgccgatggctcgcttcaatgcgcgtcggtctgtcatcgaatacgcagacaagcgatcgctcgccgcgaaatcctcaggaaagcagtttagggatgggggcacgaacggtccctacccgttcgggtagttcgacatcgtggcttcccggatcggttgagaatcgatcgcacgccagtaaagcttgcgaatctcgacatcgggtgtagcgcacgattgggacggcgtcgcgaacggcgtctgtatcgggcagatacgcatgctgcgctgccaggctcgccgccttggtctcgagcgcttcacgcaatgagtacagttctatgatcatttgatgcgtgggccgcgcgacggtcggcgcctcaccgcggctcgtacgtcaacaggatttccgcgtcgacacctgacgcatggcgacagagatcccggatttgaccgagcatgtgcccctatcacccgggcgacctgagagcagcgatccgttctggatgtcggtcgcgtcgaagcgattggatggcgcctgtcggctcggcggctgatcaaacgcagcctgtcgcaagacgcctgacgcgaccattttccagtgtacgaccggctaaatcgcttgcgccccagatccttggatatggggcaagaccgatcaggtggaggccgagcgtaccctccccaggatcgtgcatgtggatctggttcgtccgcgcggcgtggcgcaaaacttgtgaatccttccccaagacgcctagaattcaatcatggctgcattccacatccacaaggaggctgtcatgactcagtcgatgattggttgggtggttggtcttgcggtggtcgcggtggttgcagtcgcgttggcgcgccgttaccagagcgaacattcaagtaaggaagtcgttcagtggctggactcccatcacttggggtggatgcaccgcaaacattgacctctcggcgctggcggcgataaaccccgccttgccgaagtttaccgagggccaaacacacggatgcaggcaggcgggtgaagtctgccatgtcgttgtctcgccaggggtcctggcaaggaaggcatcatggatgatgaagtgtgtacgacccacacgcacgtggcacgccttcgcgtaatgcagaccacgtctgggcgctaccgcggaatcgtccacttgcaccgcatcggagaggatcccggcacctctgagcaacacgataccgaaggggattttgcatcggacgtggaggcgcgtgacgccgcacgaacgctcgcacgcagattgctcgaagagcaaatccaggggcacgaaaaggcgcgagacatcgatcgaatctgcgtcggcggcctggtcgttacgcaacgttgatcggcaacgcgacgtccatcagcgcgtagcgcgccagccgcacgatgcggccgctcgtccggtgatctgccttgagaacacgggacagaaaggaatgtcggtgttacgacgcgagtttccctttgaccggcagcatggcgtcggctcgcgcaatttcagatcgggacgcgtgtctccgattgatgcgcgctccgatgcgttgctgttcaacagcgagccgtgtcaaagaactgcgccgaacatcccatgttcgcctcggttctgatcgatgatgtcttctgcgtaacgttgcgaagcccggcgtgcgtcaccggcactggcaaacggcgaaccgtcgacaagcttgaaggtctggctccgggtcagcgtggtgtcagtgccgcgcaggcaaaccttgaccgccgcgtcgaaaccggcttcgtagttgtgagcacggccagagcctgtgtggaagtgaggataaatcagcggatatatttcgaatccgcgataggtacgcatgctcatgatgaactcctggtgattgacggcgacgaattgcgtagacgagcgcaatcaatcttctatcggcgctacgtggttagcgtcgaacaaatcggtttcgaggcacaccgggcgaagcccgttcgtctttgtgccggaaattgatacgtcctttggtgaggtcatagaccgacaattccagcttgacccggtcgccagcgagaatacggatgcggtgtttgcgcatgcggcccgatgcgtacgccgcaacgaccgcgccgttttccagggtgacgcgaaacctgctgtccggaagcacctcatccacgacgccgtccaattccagcaattcttcctttgccaaatcaatttctccaatcaatgtgacgtgccgcaatcgcagcggcgtgcggatatccggtccccgacagggagcggtttgagtgcaaatatcgaaaacgcccatgcgtggggcgcgtaccgacgcgacatgcgggccgcacctcgtccgggcgttaacgtgtctcggtggagcgcttcttgccgctcgatttgatgggcgcagagggtgcattcggtggcacccagttcagcgccgtgccgagcaccggcaaatccctggcgcgccgtggtctcgcgagtgatcttttgttgcgcgattgactcttggtcaaagttgcctctgtatgcgtcgatcgcgatctcacgatgaatgagccgcccgatcgttcgccaccggatgcgcggcatccccactttcttccttggggtgtacgtctcgaggcgaaacggtagccgcagcagagctgtgagtgcctgcagcggatgcgaaagtccccgacgatgattgcgtggccgatcctgcacgcaggaccgactaatgatgtggattactgaggaacgatgttcgaggcctgcagccccttgggcccgttcttcgtctcgtagctgaccttttgaccttcggccagcgtcttgaagccgtcgccgcgaatctccgagaagtgcgcgaacaggtcatcgccgccgctgtcaggcgtgatgaagccaaaacccttgttgtcgttgaaccacttgacggtaccggtatccatggaacttctcctgatattggacaaatgtatgcgccccgatagggagcacgaaaaaggatcaaggagggagaggacaacgaataccgcgttccgcggtcagtgatgagcagcaatcgcgcttcttgaaggcttcggacacccaccctacgcggggcccaacaccctgtcaagctgtttcggtcggcgcatttcgggtggcagcgcaagaacacaccgcgaccggcgaggctcgccccggttgtatacccttggcgccgtggcttcgatttgcttcgaatgtctaattgaaatttcgacgataccgtcgtggccccatctccccgtgtatcggcgattgttcacacgcggctgagccggtccgtcccgcgcccaatcggggcggcatgccatgcggcggttcgcgcagaactttcgctgtacaagttcgccaatgggcgtaggatggggtcgttgactgactcactaccgattcccgcgccactcaaggcgccctccctccgaacgtgattgggcctctcatctaaaccgcgcaatgcggacgagcgcgccgcgtatcggctgcgtatgtgaagcgcctgatcgatgcctgtctacaggacacgagcgtgttggatcacgcgtcctgatcccttcctcggttcatcctgtttctgcgtccgcggcgccgccacagactcaaacacgcctggcgcatggcgcatggcgcgccggcaacgtcgagaggctggatatgaacaggaatgacctgttgaagtggattcagcgcaatggttccggtgtcatcgaacagttcctgccgtacgacgctcgcgccgagatggatggcgtcattctcgatcgtcgtcatgaaatcgatgaggatgccttcctgatgttttctcgatccgcgcgctgttgcgcaaatgcggaacggtgagccgcgaaccggaccaggaagcaggccggatcatggcacgcctcaagctttgactgttctgatcgcgacgatacgcttcgcggtggccacgggccccgcggcaactgaaggaggaaggaaaatgcaactcgactcaacccgattccatatcgacccgacaccgcgcagggccgacggggaatacatggcacacgcgcggatcagcatcgatcgtgcagacggcagtacgtgcgacgttcaactgagcggagacctggctggcttcgacgtgcgcgaggatgcgattgcctttgcgaaaaactgggcgcacgaatggctcgacgcgcatttggccgacgatctccccgcgttgacgaattgaaattcgggtggcacgccagccgcccgagcaatcagggcgtcgccgggatcgaggccgacggcaatacatgctgctgccaaggcaggttgacgcggtgtcgaaggtcggtcgagaggatggccatccttggagggccgcagaccaaggcagcaagcacgccctccaacggcctcgtcaccgccagatcgggccgcatgcgttccgcatcctcgaagtccgcgactctcgtgagccgaacttcctcccaagtgcggcacgtcgcgtcgggatatcattccagccggtcgaaggcacccgcttcgagatctttcctgaaatgctgtagccagtcgctttcgtcgccgatcacgtattccttcgtaatctgcgtcgagagcctggtgatggtgacatagccctgcagaccgaggttctcatcacccttcgggtcggtcgtatccgtttcctgaagatcgaaatcgccctcagccaagccatggcgctccaaggtcgccagaaagtctctgtgttcatccggttcgatcagccgcatatccggcccctcgtgttcagcggagatgccgcgaggccgacggcacgcgttcgagcgttgaaatcatgcataccgaactcatgtggaatacctcacgatccccacatacggcgctaccgggaaacaggcgtcatcacctgcagttttatcgtctgggtcctttcatgctttccgactccatggccgcattccactcctcgctcgcctcgatagggtccatcgcttcgtcgaccgaagccgttgcgcgctcggcggccgctttggtttcgtcctccgcggagtcgacatcgctgttgccgtcacccggggagcagcatgtcctgagcatcgccctcagctccggcgtgtcccacggcaggccacgccgggttcggacctttatgtagtgtttcacttccgcgtcctgctccgcggttagcggcaggccccggaaggtgctttggggtcggagtctgtcatcgctgtctcctcctgctatggcgtcttcagtgtagtcccattgcgaccatgagagtcgtgaccgaagcgctcattcgtcgaatcaaatgccgtgcgtcgccgcggcaggcaacagccggccatcggctgtcgttggctgcctacgtcgccatgacattcgaccggttgagtccacctcagtcaaatgacattccgcccgtccatgatcgacttatcatgcaggaatacgaattgatatgaccatgcactcggaagatattggagcggagctgaccagcgacggcccatggctgcaactgaccgacgcggttcacgggatgcatcggcgatgcgggcgatgacatggcgcacgcaggccttaaacgatccatacgtgcgtagcatgttgacgtcaacggaacgggacaccaggtcgaaccgctaccggccggcttcggctcgttgctgcgggcacgccggagagcgaacatcgagcgtgcgaaggagtaagggcagacgccaccgatcgcctatgctggaagctcacgaggagccgactatgacgccacatgacgtgatgatgattttcgagcgtaggaacgcagagggaaaggcggccgccgatctggatcatgcttgtgccggattcgctggctggttggcggaggcatggagtcgattgagtgaggatgagatcgcagttctgacgtcgatcggcgcctcgctgtatcgcgaggggtatgcgaggcggtactaggcaggctcggggccagcgcgaatatattgggcggagcggaccgaaagggcgtataaagttcgaatgactatccctccgttaccgccgagtcggtcctgggcctgttccggctcattgccgggagggaggagcgccggacttccggcgaatcggcaaggatggcggcgctccaggctcttgccgagcagcttgcacgcaaccatcaggcaatgacggaagacagttgggatgcagccgtccgtgttggcggtctgctgttgcgagcggaaatgatcaacaacgacgctgacacggtggcgcttgacctgctaagccggctgcggcgacggaaatgaaaagctcgttcgagcgtatagcaagtcgccccctgcggagtggccaccatgtcgacacacctgcttcttctctacaaggggtacgaacttcatcccctcgtcttcgcccgtacattcagtcgctttgacgggcattcccgttatgccgaagggtatgacatcgcggtacggatatgccgcccgggcgcgatagcaacctccgctgcgagccgtattttcaggctgggccaaccgcatacatactccgactttggtatggcaaggcgtgccgcccggcagcagggaaaggacatcatcgacggaaaggtgagtggagcttcggtcatcgacatgtagttcggtcaaacgcagcggtcggccacgacgacacgagaagctgaacgcacgcattcttcctcaccggtatcgccaccatgcaaagtgatcgcaatgcgattccgtactacctcgtcttacggactgactgcccaccgtatgttctgaacgctgaccgcctcgtgctgcgccgcgcggcaagccctctcctgcgagcgttcgcgagagcccgcggcgcgccgacctcgatcgcggacgacgcatggagcgacttttccggctcggaatccatttcgctccttgagcgcacggagatgcgggcctacgcactggttcgcggggccgaaagcgaacatcaactccggatactggctactctctgactgcaccaacgtgcgcattccttgcagacggcgcgctcagcagcctattcgaaacgaggtctgtttgcgaagggattcggtccgaaaaatcgtcgatggcggtgacatcgctttgctccgcgtagcagcaccaattttgcatctggaggcacattgatatcgtccggccggcgtcgtgttcggtgctggacttgccatgcctctccaagcagttcgtcgaaaagatcggtgcagtggcgaaatcgcgccatatgagccgcgaagcgttggtggccgagtgtacggaaggaattggccacccagcgttgcggtcctcctgccacgaacctgtgttggcgtagctgccgaacgcgactcggcgaattcatctgcccgggttgcgtcgcttcaccgatgcgggacagtgatgcatgcgccgtttgtcgtcacgagcgacacgccagtaaaaagccggcgcttggccggcttcgagttccgccttgctggggcggctccacgttctgtttgagagcggagagttttgctacacatacgctacaggttcggcagaaaacccatgcccagacgcttccttgcatcggaaatacgctgcctgggtgtaacggctttccacgaatgggcacggcttctctgccgctccgggtgaaccacgggcattccatcgtcggtcgcgcgtgcctccgcctgttcttgctgctcgtccttcgcgtttttcccatttcgggtcatcgttcatcaacatgctccctccacaaccccggtttcgtcattgattggctcgcgccgcccgagtcgagataaaaccgcgcaagcgatacggatcgcgacggcccacatcgatcacggcgtttacatctcgatgaagtctgcggccgatctgcagtccttgcgtcatgtgtcagcttgcgcgtgcgagcatctaaagtcggtacgctgccgtacgggcgggatggcatggatgcgggtccggcaggagcgtagaagtcgaaacggtgcttgctgcgttcgtgataatcaagcagcgcatccttggacagatccatgccccctcaatacccgcatacgcggcgagtccaggtcagaaagaagacgcacgtagggtacgcgtgcaaacgggggctgacctcacgagatcgtgtatcggttctggggtcctcccttgtaaaggtctcgggcgagtcccagaatccggtcgcgattgcggtcgaaggccgcaagcaaggcgggctcgccagaatccatgtcggagttcagtttcgccagcatcgcatcgtcgaccagaaaggtaatctcgcgagaattgtcgtagccccagaaacacacacagtgtctggaagcgtcgtaggagcgactgggattcggaaagttgagcgtcacggtgctattcgccatctaactctcctgacagatataacgccacttgctcgcgttgacatcgatgcgggcgtcattttcgcgccgcttctcggcacgctcgctgtccgcgcgcttcagtgccaaggcacgcgcctttttcacgtcaacgtaatcgctgtggctggcgggcgtggttggcttcagtgcggtttgcttaggcatgccggttcccaaagagaatttcaaatttcaggaccgtcgcggtgactgaatttcgtcgtcggccgccctatacgaggaccggacgacggcccgcgggcttgccgccgacggcatctctcgcgcacggaactggcggatcaaacctcggagggaggctcggttgacgcgcgaagttcgcagcttcgacgttcgcgcgcaggatcgtcgtggtgagccttctgcttggctgtgcggacaggggaagcgtaaggagtcggagcaaaaccatcggtcacgcacatcgaacgtcacgagaatgcgcgctataccacggccatgcaagcgctatctcgcgtcagcgcacgggcgatcaaaccccgtaccggcaatcgtcaatcaaactgtaccggtactgtacataaaaccgtcgctaaactgacctccatcccagtccagaacagaatggagaatccgcgatggaattcctcaccctgagcgcgctgcccgccggcatgctgtttgcgctcgtcacgtcgatcacgcccggcccgaacaacacgatgctgctcgcgtccggcgtcaatttcggtttccgccgcaccatgccgcacctgttcggcatcagcaccggcgtcgcgatcctgatgctctgtgtcggcttcggcctcggcgaagcattcaagcgcctgccgctgctctatacgatcctcgaagtcgcgagcgtcgcgtacctgctgtacctcgcgtggcgcatcggcacgtcgggcgaagtgaaggcacacggcggcaagccgcggccgatgacgttcatcgaagccgccgctttccagtggatcaatccgaaggcatggatgatggtgctgaccgccgcgacgacggtccgcctgtccggcgactacgggatgaacgccgcgtggatggccgtcgtattcattctgatcggctttccgtgcatcagcctgtgggccgcgttcgggctcggcctgcgccgcttcctgtcgaatccccgcgcgctgcgcctcttcaacgtgacgatggccgtgctgctgatcctgtcgctgtacccctgatcgcgcacctgctgccgcagtgagcgctcacggcgcgcccgttgagattcgtgccatgcaggcgtaccctttggtacgggcgcgcgcaaccgcttcgccggttgcgccgctgctgccgggagagtgccgatgaagccactgctgagggcgggtgaacacatcgaggggatgcactggatcgccgagtatcgcccgctcacgcacgagattcgtgtgttgcgcgaagacatcgagatcggcatctattgcgcgccgccgacgatgttcggcgaagaggaagacatgggcgccgcgaacctctccgatcatcgcagccgggaggccgcgctgcgcgcgtatctgcgcaacttcgtgaaggaacacgacgcggaagaataaccggcggcccgacggccgccgttcggcgggccggcgcatcgcaccggcccgcgcttcgctcaatgcccgagcgattcgatcttgcctgccggctgcgtcacgccatgcggccgcgccatctgcttgatcagcagcgcgacacacgcgagcaagcccgcgacggcgatcgtcgcgaacacgcccgcgaacgagaaatgccggcgcgtcagctcggcgacgaggaacgatcccgcaatcccgccgaagcggccgacgccgagcatccacgcgacacccgtgccgcgccctcggtcggatagaacgcggcggcgagcgccggcatcgacgattgcgcggtgttcatcagcacgccggccacgaacacgaccagcacgagcagcccgacgttgccggccgcctgcccgatcgcatacacgctgacggccgtcagcgcgtagcacacggcgatcacgcggttcgcgttgaagcggtccatcagcacgccgcacagcacagcacccacaccgccgagcgggaacagcgcggagatcagcgtcgcgctcttcggcgtcagcccggcatccttcagcaggatcggcatccagttgatcgacgcgtagaagatcacgagccccatgaagtacgcgagccacagcatcaccgagccgacgatgtacgagcgcgacagcacgacgccgaggcccttgctgccggtctgcggcgcggcttcggtcatcgcgaacgaaccggcgttcagcgcttcgctcgagatgcgcgcaagcgttgcgcggatcttgtcgacatgctggccgctcgcgaccatgaagcgcaccgattccggcatcttcagcagcaacagcacgccgagcagcagcggcgtcacgccgccgagaatcagcacgctgcgccagccgaaatgcggaatcatccacgcggccaggaaaccgccgaacgcggcgccgagcgggaagccgcagaacatcaggttgatcacggtcgcgcggcgcttgtccggacagaactcgcccatcatcgtgaccgcgttcggcatcgccgcgcccagcccgacaccggtgatgaaacgcaggatcgtcaggtgcccgatggtcgtcgagaatgcggacatcaggcatgcgacgccgaacaggaataccgagccgagcagcagcgaacggcggccgagccggtcggacagcggacccgacacgagcgcgccacacgcgaggccgaacagcgcggcgctgagcaccggcgcgagatcgggcttggtgaggttccattcgccgagcagcgacggcgcgataaagccgatcgcggccgtatcgaaaccgtcgagcagcacgatcacgaaacacatgaggaacacgagccattgaaagccgccgaacggctgctcgttgatgaaggtctggacatcgaccacgggtgcgcgattcatcgctagtctcctgtgtcgatccaagctggcgccttagcgcctacctggatcccatgcgtcgtggtcgaccggcgttggcgcgtcagcgcttactccggtcccaagcaacgctaataatgtatgaccaatacggcatggcagccgcgcccttcctttgttcgtccaccaatcatccggtgtgccgtgcgccgatgctctgccggcgcattcatcgattccgtcgtcgacggcccgcttgcgacagcgggccacgcgatcggttgcggccgccctcaaccggccgcgcctgaccgaccgtcttacgcggccgcgtcctgttccttgaagatcttgtccgcgagatggaacgcggaattcgcggccggcacgccgcaatagatcgcggtctgcagcagcacttccttgatctcgtcgcgggtcacgccgttgttgcgcgcggcgcgcagatggagcgcaagctcctcgccgcgattgagcgccaccatcatcgcgatggtcagcaggctgcgcgtatggcgcggcaggccgtcgcgcgtccagatctcgccccatgcataacgcgtgatcaggttctggaattcgtcggtcacctcggtacggttctcgatcgaacgatcgacgtgcgcgtcgccgagcaccgcgcgacgcaccgtcatccctgcttcgtaacgttcctggtcgttcatcgccggtgcctcacgcggtcaggaaatcgagcagcgcgcggttgaagccgtcggtgcactcgatgttcgaaatatgcgcggcgtcgaattcgacgtgctgcgcacccggaatcgcggcggcgagcgcgcggccctggtcgggcggcgtcgacatgtccttcgcgccggtcacgacgagcaccggcagcgcgatgcctttcacctcttcgcgcaggtcggcggcattcagcgcgtcgcagttcgccgcataaccgtccttgtcggtatggacgaaggtgtcgcggatcgcatcgaacaggcgcggctcacgctcgacgaatgcgtcggtgaaccagcgcggcagcacagcgtcggcgagcgcggccatcccttcggcgcgtgccttctgcgcgcgcggggcccacacttccggcgaaccgatctttgccgcggtgttcgacaacaccgcgcgcacgatgcgcgacgggaagcgtgcggccagcgccgcgcccgtcagcccgcccatcgagatcccgcagaaatgcgcgcgatcgatgccgacgtggtcgagcaggccgatcacgtcgccggcgagctgctcgatcgtgtacgaaccggccggtgcgtcggaatggccgtggccgcgcgtgtcgtagcgcaggatgttgaagtgctgcgtgagcggacggatctgcggtgcccacatctgcaggtcggcaccgagcgagttcgagaagacgagccacggcgcgtcgtcgcgcgcggcacggtcgatccggtaatgcagtttcacgccgttgacagtggcgaaaggcatcgaggttctcctggttattgcgtgcccgcgtgcagcgcgagcacggcgtcgacgcaggcctgcgcctcgccgacgtaatgagcgggatcgagcagccgcgcgagcgcgtcgcgcgacaggtgcgccgacacggtcgcatcggcggcgagcacatcgaacagcgtcgagcccgtgcgcacggcttccttcgacgcatgctcgacgacgtggtgcgcgtcgagccggccgatcttgtcgccgagcgcgagcatcaccgcttcgccgagaatcagcccgcgcgtcagttcgagattcgcggcaaggcgttcggtgttcacgtcgaggcccgcgacgatctgggcgatctgcgcaagcgcgccgccggtcaggcgcgcgagatcgggcagcgcttcccattcggcctgccagccgccgagcgcacgttcatgttcctggaccatgcccgcgaacaccgtcgcgacgaggttcggcgcgcgcaccgcggcggtgagcaccgccgcgcaaccgaccgggttgcgcttgtgcggcatcgtcgacgagccgcccttgccggcggcggccggttcgccgagctcgccgacttcggtctgcatctgcagcgacacgtcgcgcgcgatcttgccgagcgtacccgtcagcatcccgaagcaggacgcggcttccgcgatgcggtcgcgctgcgtgtgccacggcacggccggtgcggcgagcttcaggtccgccgccagcgcggccgtgacgccggccgcgtgctcgcgcaggctcgcgagcgtgccggccgcgccgccgaactgcagcaccagcgcgcgttcgcgcaattcggcgaaacgcgcgcgatggcgcagcagcgcgtcaagccattgcgcgaatttcaggccgagcgtgatcggcagcgcctgctgcaaccacgtgcggccgatcatcggcgtcgcgcgatgcgtgcgcgcgagcgccgcaagcgacgcacacgcttcgtcgagcatcggctcgagcacgtcgagcgtgtcgcgcagctgaaggacggtcgcggtatcgatgatgtcctggctcgtcgcccccagtgcacgaacttcgcggcctcggggtcgtcggccttcaccagcgcggtgagctgcttgacgagcggaatcgcgagattgccgccgagcgccgcgccgtgcgcgagcgcgtcggcgtcgagccggccggcgtcgcacgcgcgctcgatcggcgcgaccgcggcggcgggaatcacctgctgcgcggcgagcgcgcgcgagcgcggcctcgacgtcgagcatccgctggatcgtcgcgcggggcgaccagatccggttgagcggctcggtgccgcagatgagggaggtcaggcgggcgctgtcttcgagcatggcatcagattgggaaacggcgtgcgcctattgtccacccaagcgtgccggcatgcgcgcaaacggacgcgccggcacgcctgcggttcaggcagccgccttttgcgtcgcgtcgatcagcggcacgccggtcagcttctgcagttcgtcgaacgacaggtcggtgaagatctcgctcacggccagcccgtcggccgtcacgtcgagcacggcaagatccgtatagatgcggctcacgcattgcacgccggtgaccggatacgagcactgcgcgacgatcttgctctcgccctgcttcgtcaggtgctccatcatcacgaacacctgcttcgcgccgatcgcgaggtccatcgcgccgccgaccgccggaatcgcatcgggcgcgcccgtatgccagttcgcgaggtcgccgttcgccgatacctggaacgcgccgagcacgcagtaatcgaggtggccgccgcgcatcatcgcgaacgaatccgaatggtggaaatatgcgccgccggtgagcagcgtcacgtgctgcttgccggcgttgatcagttcgtcgtcttcctcgcccggcgcgggcgcggggcccatgccgagcaggccgttctcgctgtgcaggaagatttccttgctcgggtcgaggtggttcgccaccagcgtcggcacgccgatgccgaggttcacgtacgcgccttcggggatgtcctgggcgacgcgcttggccatttcatcgcgggtcagtcgtttcatctgaatatctccctcaagcggcttgcgatgcagcatgttcggcagccagctcggccgcatgcgcggcctgcggcacctcgacgacgcgctggacgaaaatgcccggcgtcacgatgtgttccgggttcagcgcgccgagcggcacgacttccgacacctgcacgatcgcgaccttcgcggcgctggccatgatcggcccgaagttgcgcgcggtcttgcgatacacgagattgccccagcgatcgcccttgtacgccttcacgagcgcgaaatcggcgtggatcggcgtctcgaacacatacggcttgccgtcgatcacgcgcgtttccttgccttccgcgagcttggtgccgtaacccgtcggcgtgaagaagccgccgatgccggcgcccgccgcgcggatacgctccgcgaggttgccctgcggcacgagttccagctcgatctcgccggcgcggtacagcccgtcgaacacctgcgaatcgctctggcgcgggaacgagcagatgatcttgcgcacctgcttcgccttcagcagcgccgcgaggcccgtctcgccgttacccgcgttgttgttgacgatcgtcaggtcgcgcgcgccctgttcgatcagcgcgtcgatcagctcggacggcatgccggccgtgccgaagccgccgatcatgattgtcgcgccgtcgtggatgtcggccaccgccgactgaagcgattcgaaaatcttgttgaccatgtctcttcctgatacgaacccgcggctcgatgcgcggcctgtcgagggacacgcgcgtgccgcgtgtcgcgccggggccgatctcgatcccggtatttgttcgctaatcgaacctagattcgattagcgaacgatgggccgatcatagagtcgcgcacagcgcgttgtcaaggcgggttccctcggggtgtcgcgtcgtcgaacggcagcccgacgtagttttcggcgagcgactgcgcggcggcccgcgagcgcgtcacgtatttcagctcggcaaacttcaggcgattgacgaacggcgagtcttccggcgacgagtgcagcatgttcgtcatgaagtacgagaagtgctcggcgcgccacacgcgttcgaggcaggtcgccgaatacgcgtcgagcagcgtcgcgtcgccgttgcggtagcgcgcgccgagcgcgcgggacagcgcgcggacgtcggccaccgcgaggttcatccccttcgcgccggtcggcggcacgatgtgcgcggcgtcgccggcgaggaagaggcgcccgtgctgcatcgtctccgacacgaagctgcgcatcggcgtcacgcttttctgcgtgatccggccctcggtcggcgtccagcccgtgtcgttcgagaagcgcgtgtgcagctcgtcccagatccgcgcatcggaccattcggtgaggtcctcgtcgggcttgcactgcaggtacaggcgcgtgaccgtcggcgagcgcatcgagaacagcgcgaagccgttgtcgtgatgtgcgtagacgagttcgtcgagcgacggcgccgcgtcggcgaggatgccgagccacgcgaacggatacacgcgctcgaacgtgttcagccgctcggccgggatcgtctggcgcgcgatgccgtggaagccgtcgcagccggcgatgtagtcgcagtcgatgcggtcttcgcggccgtccgcatgcttgaacgtgacgagcgggtgttcgccttcgacgtcgtgcagcgcgacgtcgctgacttcgaaatgcatctggtggccatgctcgacgcccgccgcgatcaggtcgcgcacgacttcatgctggctgtagacggtgatcgcgcgcccgccggtcaattcggacaggtcgatgcgatggcgctgcccggagaacagcagctcgatgccgtgatgttcgagcccctcgcggcgcatccgctcgccgaggccggcctcgttcagcgtgtcgaccgtgccctgttccagcacgccggcgcgaatgcggttctcgcagtattcgcgcgaacgcgcttcgacgaggatggaatcgacgccttgcaggcgcagcagatgggaaagcaaaaggccggacgggccggcgccgatgatggcgacctgggtgcgcattgttcgtctcctgaacattaattcgaatcgtcgaacacatttgagcgctttcccgactatgcggcaacgcgattcaggagatatgttgtatacgttttcaagatactggcccggcgatggaagcgctcgatctgaacctcattccctacctcgtcgcgctcgacgacacgcgcaacgtgagccgtgccggcgacctgctcggcgtcagccagccgcgcgtgagcacggcgctcggccggctgcgcgagtacttcggcgatccgctgttcgtgcgcacgtcgcgcgggatggaaccgacgccgcgcgcgctcgcgctgctgccggccgcccgcgacgcgctcgcgcagatcgagcgcggcctcgtcgcgccgcacgacttcgacccggccgcaagcacgcatacgttctcgatcgcgctgtcggacgtgggcgagatcgtgttcctgccgaagctgctgcaggcgttcgcgatgcgcgcgccgcacgcgaacctgcgctcggtctcgctcgcgcacgacgaagtcggtcgcggcctcgaagccgggtcgatcgatctcgcggtcggctacttccccgatctcgacggcaacaacttcttccagcagcggctgttcacgcaccggttcgtctgcctgatgcggcgcggccatccgttcgaacaggcgccgccgttcacggtcgaacagttcctcacctgcgggcacgcggtggtgcgtgccgaagggcgcagccaggaggtgctcgagaaatatctcgcgaagcagcgcatgcagcgccgcgcggtgctcgagacaccgcacttcatgagcctgccgttcatcctgagccgcaccgacctgatcgcaacggtgccgcatgcgatcggctatgcgtatgcagccgagcacgcgttcatcgtgcccgtcgagccgccgctcgccctgccgcgcttcgacctgaagcagcactggcatcgcaagtaccacaacgatccgcgcaccgcgtggctgcgcggcgtcgtcgcgtcgctgttcaacgacgagcaggacgaatggccgaagtgagtgccgggccgcgcacgcgacctgcgaaagcatgaaacaatgcccggattccgcgcgccccggcggcggcattcgatggagcagatagatggctaaaaagaagtccgcgcggcccgagccggccgcatcccgtccgagccgcgaagaagcggaagacgccgttcgcgtgctgttgcgctgggccggcgacgatcccgcacgcgaaggcctgatcgacacgcccgcgcgcgtcgtgcgcgcctacgagcagttcttcgccggttacgcgctggagccgcgcgacatcctcgcgcgcacgttcagcgaagtcgacggctacgacgaaatgatcgtgctgaaggacatccgcttcgagagctactgcgagcaccatatggtgccgatcatcggccgcgcgcacgtcgcgtatctgccgaaccatcgcgtggtcggcatctcgaaactcgcgcgcctcgtcgacgcgttcgcgaagcgcctgcagatccaggaaaagatgaccgtgcagatcgccgacacgctgttcgacgtgctgcagccgaagggcgtcggcgtgatcctcgaagccgcgcaccagtgcatctcgacgcgcggcgtgcacaagccgggcgtcgagatggtgacgtcgcgcatgctcggcacgttccgcaccgatccgtcgacgcggcgcgaattcctgtcgatcgtcgcgaatccttcttcagtcaacctgacgaatacgtaatggagtcgacgaagcaaacggcgcacgcgcccgtcgtgctcgtgaccggcgccgcgcgccgggccgggcgcgcgttcgccgagtatttcgccgcgcacggctatcgcaccgcggtgcactacgaccgttcggccgatgcggcgcaggccgcggcccgcgcgatcgccgagcgcgggcacgattcggttgcgttgcaggctgacctgtcggatgccgaacagatcaccacgctgatcgaccaggtgtatgcgcgcttcgggcgcctcgacgtgctcgtcaacaacgcgtcggtattctggcaggatcatttcccgagcttcgacctcgcggcgttcgaccaggcgtgggccgtcaactgccgcgcgccgatcctgctcacgcgcgcgttctacgaacgggcccgcgcggccggcacgcagggtgtcgtcgtgaacgtggtcgaccagaagatcaaggaaaactttcaccgcgaccatttcagctatacggtcgcgaaggccgcgctcggcaacctcacgcagatgctcgcgctgtcgtccgcgccggtgctgcgcgtgaacgcggtgttccccgggctgatgctgccgagcgacgaccagacgcaggccgacttcgaacacgcgagccgcgcatcgacgccgctcgcgcgcatcgcgggccccgacgacgtcgcgagcgcgatcctgatgctgacgggcaacgcgtacaacggcgtggatttcgtcgtcgacgcggggcagaacctgatccgcgtcgaccaggacgtgctgtacaagcaccgcgcgcccgacagcaagcactgaccgacgcgcgcggcggccggcgcccgcgcgccgcgttacggcttctcggtgctcccgccctcgcgaaccttgccctgcgcgacgctcgtgccgggcggcacgctgtgcgtgagccacacgttgccgccgatcaccgaaccgcgcccgatcgtcacgcggccgagaatcgtcgcgcccgcgtagatcaccacgtcgtcctcgacgatcgggtgccgtgcgttgcccttgaccagcgcaccgtcgccatcggccgggaagcttttcgcgccgagcgtgacagcctggtacacgcgcacgcgctcgccgatgatcgccgtctcgccgatcacgacacccgtgccgtggtcgatgaagaagctcgggccgatctgcgcacccgggtggatatcgatgccggtggccgaatgggcgatttcattgatgaatcgcgcaagcagcggtacgccaagctggtgcagcgcgtgtgcgagccggtggtgcatcatcgccagcacgccggggtagcacagcaggatctcggtgatgtgctgcgcggccggatcgcccgcataggcggcctggatatcgctgacgagcagcgcgcggaccgccggcaactgccggccaaattcgcgcgcgatctcgaacgcgcgttcgtcgagctcggcgaacggcgtatcggcatgctcgggcaggaacggcagcgcgcggcggatctgttcggacaggatgcgcagcgtgctctcgagcgtgtggccgacgtagaaatcgacgctttcgtcggtcagatccggtgcgccgtagtgcgtcggaaacatcgacgcgcgcaggccggtcacaatcttgcagatcgcatcgcgtgacggcagttcgcggatgccgcgcggatggcgcgtgcgatggagttcctcgcgcgactcacgcaagccggcgacgatttcttccaggccccactgacgggcgggtgatgtcgacatatatcaatgcaggcggccgcgctcggtcgcacggccgctaataaagtgacgggttccgcaagattaccgcgttttgtgcccggcagcggcacgccggggatcggccggacggccgagggcaccgaatcgcggcggcgtcagatcgtgatgctgctggcgtcgatccatcgcacggcccagtcgcgcgcgtgcgcgatcgcgtcgccttcgtcgttgaactggagctcgatcgggaaaaagcggttcgcgacgagctccccgtcgctcgatcgggagatcacgacgtagggcttgaacgaaccgtcgctggcacgcgcgggtgcacagttcaacagataaccgcggtgcgtgaaggcagtagtcgcttgcatgaatccgccacctctagtcccttgctttgttgttcactacccgtctttaagggtgctgcagcgcccggcgcgggcagaggcggcgcgactcaatcccctgtcgccgcttcgcaggaaaagaatcatactctgtagaaaacgcgtcttctagctgaaataaatcacgacaaatcagtgcgcgtcgagcgaccgcggcgatcgcccgtgcgccttttcccgtcatgcccggaacgggatttgcttcgatccggaacgcttcgccgcgaggagagccgcgatggaatcatccggtcaaaccgagcgcttgcgcccacgcagcatcgagctcgacaacgacgacacgcacgacagcacggtcgacaccgacggcaagaaccgcgaggcgtcgcgtctcgccggcggcgggccgatctcgcccgaccagatcacgcgcagcaacgcgtcgctcgtcaatgcgatgccggaagccggcgacggcttcgccgggttcgacagccgccccggcggcaaccatccggcgttcgcgctgcgtgccggatacatggtgatcgagaaaggcttcgacgcaccgccggcgatgagcgatgcgccgttcggccccgtccaccggatgtacggcagcacgtactggcccggccaccagcggcggccggagcgcgtattcgagctgacggccgtcccgagatagccggcgcggcgtttgaatcgatcgttcgtttgccaaccggtatcggccgacagccgatggccgaggatcggcgcacgcgacggtgcgccgaccatggaccggcaactgcgcgatgcaggaacgaacgattccgcgcgacggcgccggcggtctcatgcacgccgtgaatcgcgccgatgcagatgcgttgatcgaagtcatgtcgaaacggcgcgattgcgattgaatggcgatgcgggcgatgcatccgcgtgaccgtcgcgcggtgtcgcttcgatcggcgcgcgtggcgatgcacatgcatgcgcatgtgccgcgcgcgacaacgctgcccgcgcatgcgtttccaccgacgatgcggacgacggcggcggccacgccgcacgacacgtcccgcacgtcactgcatgcacccgtgcatggcgtgcgccgcaaaatcggaggcggcaccgccgcgcggcacgaccggcacctcgctgcaaagtcccggccattggtttaccctgcctcgcagcatctcgcatcgccccgcccgatcggccatccggccgacttcgtttcaacccgccactcggagacactatgtacaagcgtattctggttgccgtcgacggcagcgacacgtcccgccatgcgttcgatgccgcgctggcgctcgcgaaatcgcacggcgccgagctgcaaccgttctacgtcgtcgagaacgccgcgatctactacaacgtccccggctacgatccgtccgtgctgcgcgaccagctcgtcgcgcagggcgacgcgctcgcgaaggatttcgcgacgctgatgcaggcagcgggcgtgaagggcgagacgcgtcggagcgaagcgacgtcgctcaacgacgtatcgtcgctgatcctggacggtgcgaaagcgttcggcgccgatctgctggtgctcggcacgcacggccgccgcgggttccgccgtctcgtgctcggcagcatcgccgagcaatgcgtgcgccacgcgacgctgcccgtgctgctgatcccggcggccgccaacgtcgacgagccggccgcgtgaacggcgttcggcatacgcggccggtcgcgacgttttgtcacccgacagcggcaagttgcggtgggacaatgattccgtcgattcaacgccggagtaaacgatcatgctgacgcccgtcgccacacgtcccgccgccacgcctcatgccggtagctgggcgcctcgccaggccgcacactgctcgacgtgcgcgatgcggcacctgtgcatgccgcagggctggcgcccgaagcgctcagtcgcctcgaatcggtcatctgcgcggcgcgtcccgtcaagcgcggcgaagcgttgttccgcgaaggcgacgcgttcgacaacctgtacgcggtgcgctcgggttcgctgaaaaccgtcgcgacgcgccacgacggccgcgagcaggtcaccggcctgcatctcgccggcgaagcgctcggcctcgacggcatctgcgacgacacgcatccgcgcaccgcggtcgcgctggaagacagctccgtctgcgtgattccgtacagcgcgctcaaggcattgtgctcggaagccggttcgatgcagttgcgcatgcacaagctgatgagcgaacagatcgtgcgcgaaacgtcgcaaacgatgctgctcggttcgctgaatgccgaagagcgcgtcgccgcgttcctgctcgacgtatcgtcgcgttacctgaagcgcggctactcgccgtcggaattcaacctgcggatgacgcgcgaagacatcggcagctacctcggcatgacgctcgaaacggtcagccgcacgctgtcgaaattccagaagcgcggcctgatcgaaatgcagggccgccacgtccagatcgtcgatttcgacggcctgcaccacgtctgacgtgatcccgcacggcgcgcatctcgcgcgccgcgccgcccgcgtcacgcgatcggtcaatcgaggaacagcgcggcgcgcgccttcagcgccgcgctgaaatcgtcgagccagccgatcgacaaacgccagctctgccagtaaaggtcgatatcgatcgttcgcccgcgcgacatgtcgaccagttcacccgccgccagctggcgatcgaccatccggtccggacacatccccatcccaatcccgtctcgcatgcgcgcagatagcccgcgacgtgcggtatccagtgctgcggcggatcgagatccgcgcgcgtcacgcgccggatgaaacgcgcctgcagcccgtccttcggattgaacatcacacacggcgcgcgacgcagtgcatcgcgggtaatgcccgcgccgaagtagcgttcgtaaaacgccggcgagcataccgcgcgatagcggatccgcccgagccgctccgatcggcacccctggatcggttcggcctgcgcggtcacggcgccctgcacgctgccgtcgcgaatacgcgaagccgtgtaatcctgatcgtcgatcacgagatcgagcaacgtttcgcgctccgtgcagaacggcccgaccgcgtcgatgaaccacgtcgcgacgctgtcgtcgttgacggccacgcgcaacgtcggccatgcgctcgcgatctgacccggcagtgccggcatccgcccgcccagctcggcctcgagcagctgcacgcgctcggtgtgacggcacagcagcgcacccgacgtcgtcgcgacgcacggctgcccgcgcttgacgagcacgctgccgacccgctcctccagcaatttcacgcgctgcgacacggccgacggcgtgacattcagctccttggccgcacgctcgaacgaaccgtgccggatcaccgccgcgagggcatcgagcaacgcgtagtcgagcattagatttccttaatctgcattaggtgatttagcttctcttattttcatgctgaccgcagactagcgctacccgattcatccgtctactgcttctcctgctgtcatccatcatgaactggctcgctttttcccacggcgccgcgctctgcgggtcgctcatcgtcaccatcggcgcgcagaacgcattcgtgctgcggcagggcatcatgcgctcgcatgtcggcaagatcgtgctgctgtgcgcactgtccgacatgatcctgatcggcgcgggcgtcggcggcgcatcggcgctcgtcgaacgctatccgaccttcgtccatgcggtgctgtatgtgggcctcgcctatctcgcgtggttcggcatcaacgcgctgcgccgcgcgttcaagccgggccatgaaacgctcgacgtgcgcggcgatgcggtcgccccgccgccgcagagcgggctcgcgatcgtgctgatgacgctcgcgttcacgtggctcaacccgcacgtgtatctcgacacgttcctgctgatcggcacggccggcgcgcgtgaaccggaaggcgcgcggctcgcgttcgcgatcggcgcgatgtcggtcagcgtcgtgtggttcctcgggctcggttacggggcacgattgctcgcgccgtggttccgcaaggccgttgcgtggcgcgtgctggacggcgcgatcggcagcatggtgctgtttctcgcggccgtgcagttgcggtagggaggagcgtcgcggcagatgcggtctgccgcgacgtggggtcagccggtcgcgatcggcgtcaggccgccgatgtcgtgtcgggcagcgtgccgccgatgggctggttgctggccagctggggttcgtcggcggccatcggatcctgctgcttggccggatcggccttggcgagttgcgtggcggcctgctcggccttgtcgccctcgtagcgccagtacaggaacttcttgccgcgcttgcccatgaagtactggcggttgaccgtccagcggctcaattccgcagcgccgacgtagccgtcttccatctgcttcttgaaacctgcaatcgaatcgtgcacatagtggtcgaagaacttgtcgaacgccgcgcgcgtcgctggatcgaggctacccagccagttgccggcaacccggacggccgcgtcgatggctttttcctgttccgaaacggagacagtcaggtatccgccgtttgcatgacgcaagcgatccgtatcttcattccactcgcgatcggtaatgaccatatgatcgtccacgccaccgggtggcttcagacggccgtccttcaggcgtcggcttctgctggcgcgccactgataatagcggttcatgtgccaaatgacctgcgcctcgagcctgtcgctgttcggcgccacgcccgcacttttgccgccccctgacccatgtagacattccatgcggcctccagctccttggaaatctcgaactgttgcccagcgtccgcaagcagttcctttggtgaacgaaacgggacgccggccttccatgcttcgatatagagattgttcagcgcaacgttggccaactcgttggttcgaccttcctggtagttgtgctcgtaaccaccgcccacgtccgagtgcatgccagggtagtacacctcgcggcagttcgcgggaatcttctggtcttcccgcaccgagtcaccgggaatttttcccgcacctcctgcgatgccacatagtgaacacattgccgcacgtagcccggaatgcgaatatcgttcgcccattccgcgtgaccgcctttgtcgatgtagtagaggtaaccgccggcgagcggtccgaaaaaatggtagcgatggccggtcccgcagcctcgacgcggctgccgccgaagcccgttgacgaaaccgtatcaagaattccaaggaaataaacgaccacttcggggcgatgcccttcatgttcttcttgttccaccaaagcctcccgccgatattctcggcgagttgctcggtcagcatgcgaacgaaggcacgcgcttccgtcgcgccccgcgagaaaccgaatacggccaggttgatctggctcacagcgggcatgtgaccggtgacatgcctgtcgagttcgttgagcatccatcggatgcgcaactcgccttttctcgcggcagccataccgagtgcgttgtcgagaccttttccggtatctcctactttgtcgcacggcgtgccgacaccttcgacatagcgtgcaacagtccggggaacgcgttgtcttcagcatgcgcaaaccgccagagcttcgcgatattgctgtacttggtcagcttgacatccttcaaaccacggccgtccaggtcgaagttgttgcccgttccgtcgaagaatgccgtgaaccacacgggcttcgggcactccttgcattgctcgatcagcagcggatcaagaatttctcgctgggcactgcggatggcgtcctcggcggggtgagatccgagatgcgtctgacaatggggattgctcacggcagtttcgctcctgtttcggcaatgtgcccagcgtcagttccattgggccggcttcttgcgcccatagaacggattgggaatttccttcaggcaggcacgaccggtcagcttgcgctgctcgtcgcgcattgaaagcgccaccttcgggactgggccatcgacgtggaagtccatatcaccttccacacggccatcggggaagaagtgcaacacgataccgccgctcttgcccttcacgggcgggcgcgtgatcgtgatctcgccttcacaccatgccatcccgggtcgggtttctcgatgcgtgtactcgtcgtaatcggggacgaggcctccaatgcgcgcttgtcgaccacgcgctcccaccacactttgaacttgcgaggcgtggtccatcgcaaatcccatgcgaggctcggtctttgcccgccgccgcctgtccagcgtgtcgcgctccgcggcgtcgcgctcttcccatcggcgctcgccgcatcgtcgaggctgttcttgtccggcggcaggaggtaaacgccgtagatatcgtaatccgtatagttgaaagaccccgccgttatgacgtcgtaattcgggtcattccacttgctcgcgtcgccgggggccaggctttccttttcagcatcgcccgtggttttgctgcacgcagccgtggaaaagaccatcacggacagcaagctgatccagcagcggttcatattgaacttccttctcttccagtcgatttcattcgagtcgcgtcgcgcacgcgccatcacgcggccgcttcctgcattcgccgccagtcttccgccggcaccagcgccagcgcctccggaaacgcctgcccctgcgccaccgcgtcgaacacggcggccatcgccggatcctcgtcgaagcgcgcgccgtaccgcaacgccagttcgcaatagatcagcagcgacgccgcgctgtcggcgccgtgcgcgcggcagcgcgccagttgatcgcgcacgaagccgtagtgctgtgcggccggcaacgacgcgagcagcgcgggcttttcggtacgcagccgctcgagcatcgtgtacggatagcaggcggcgagcagatcgtcttcctgagcctgggtcaactgcagcggaaattcggcggcctgcctgacgttggcgggcgcggcgatgtccgccgtccggagctgcagcgaggtatcgcggtgaatccagtgccgcacgccctgcgccagatacgcgcgatgcgcggcgggcagcatgtcgagccagaacggcagcacgcgcggatcgaagaagcgcatcagcatcacgctctccatctgctcgagctggacgtccaccatcggcgccagatgcgcggccagtcgctcgagcgacagcggcgacacgagcacgctcgctgccggccacggaatgctgcgcggctcgatcgcgtccgcggcatcggcaccgtcggcgccgggctgccattcgaacagcagcggcccgacgattctcgcctcgtcgtcggcggcgtcgtcgagcagcgaggccgcgacgaacgcgggccacgacgccttgtcatcgtccggcaaggtatcgagcaatgcgccatcgatcaggacgtaagcgcgcagcccgtcctgcgacgacagcgccgcctgcaacgcgtcggccgcctgcgcggcaatcatgtcattcgtcatgcgctgccctgcctcacgccttggccgcgaacggcgacgccatcgatgccgcgttgaccatgcacggcgcgcacgccgtgcccgggaacgcgcgcgcgggcaccggcaggctgtccggccccatgaacgtatgcgacgcggcatgcgcggtgaattcgcccttggtcccgtgcacgatgccgctgccgttccagcgcgtatagctggtgccgccgttgatcaggacttcttccttcgcggtgatggtgatgcggttcgcatcgaccttcacgtccagcttggccagcacgttgatgctgtccttcagcgcctggatgtcgatgtcggcggcggcggccacgagccggatgcctttttcgaacgcggcgacgcgcacggcctcctgcgcgctgaccagcatgctcttgcccgcgccgatgctcgtatgggcgccgctcgtcaacgcgacgtgctggtcgcttgcgacatgggtcgaccccgtcgtcgtggccaggatcccggccgggctggcgagcgcgagaaacggctgcgcgaactccggaaactcgccttgctgaggattgccgccggtacctctcaggccgtcgttctgcgtgcggagcgcctgatggacggcatcctggtcgccggactcctgcgccttcacgtcatgcgcggaacccgacaacgattcgtgcaggtcgtgcgccttgtcgaggcgcgcgacggtttcgtcgatgtccgtcgcatgggcgcgcgcgtcgtagcgcgcttcgctggtcaccaacaggcccttggccgcccgaaccgcaccgtacgcgtcggtccgcaactcgaacccgcgcgcgcgctggtcggtgcgcccctgcgtattgtcgatgcggacgttgtgtcccagggtcagttcgctggcgtcggtatcgctgcgcagcttcaactggagctgctgcggcgtgtcgtcgagcagcacgtggttcgagcggccgcccgccgcgttaccggcgtcgcccgacagctcgcggctgcgcagccccgtcaacacctgctggtcgggcagcgcccatggcggcatccgttccgcgttgtatgtggtacccgccacgatcggccggtcgggattgccgtcgaggcacatcacgaccacctcgctgcccacgcggggatgcgcgatcatgcccttctcgccgccggcccagccggcagccacgcgaatccgtgcgctggtctgcgctgcacgatcccagtggtagacgatgcagacccgaccgtattcgtcgacgtcaacgctgccggcgcccttcgcgcccgcgacggtcgcggtttgcggcgccagcacgcgcacgggctcgctgttgaagccacggcccgggcgccagggcgtatgccgatggcccgcgacgaagcggttgcgatactcgggcttgccgtccgcctgcaggtagttgttcgctgcttcgtgacgggcttcgagaatcaggtactcgtgatcctgcgggctgcccgacgccgcgctgaagtgatcggacagctggaaccagcgtccgggcaggatgccgtgatggttgccggccgcgtcgaaacgcgtcgcggccgcctcgatctcctccatccgcacgcgtgcgagcgcatcgccggcgcgcgtctgtttcgcgaaaccgtagtgccccacgtattcgtgatgctcgacctgcggcgcgacgcccggcggatgcagcgtcggaatctgcgcattggccgcatgcggcgccttgaaatcgaacgcggtcgcgctgtaactgccggcggacagcaaccgcaccgcggaccattgcgaaatggcgtcggcggccatcggaccgtcgtgcgtctggaaacggatcacgggcgagcgaccgtcgacggccgggcactgcaccgtgctgtcgtcgccgacgatcagcttcaggcctttctcgtcgtgctcccaccagtacaggcacccgacggcttccagatggcggacgatgtagttccagtcgctttcgccgagcccaccgccctggacgttcatcgtgcgcgcgggatcgtcgccgcgcacgcgccactcccacgacggcgcgagcccctggtaatcggcgagcagcgtgccgatctgctgctgaagcgattggccgaggaacaggcggttgttcacgcgggtccgcaggaaatggctccacgggcgcagcaccgcgcgatattccgcaatcgaatcgtcgttgcggaccagcgaaaactcggtgcagtaaccggtgaaataacgcaggccgccatcggggcgcaccatcgacaccgcgagcagcttgcccagcatgtcgtccagcgtgacgccggcctcgccggacagcagcgtcagttcgaacgtgaagtcggtcccgagccctcgtgcgcgacgagccgctcgacaaccagccgcgccggacgatgccggccgtacgagtcggtgaccgaaggcgcgtcgtcgtggggaaagacagcgtgagcaagcgcttgtcttgcaggaaaaacggagggcgaataaatgctgcaaggtcagccatgaccgcctcagaatgatctttcgttcgaatggcagcggcgcgctgcctccctatttttgggatgaaaggatatcgtagagcgcgaccagcgacaacgctgacacgacccggtaatttcttcgcctctcgcaagaaatcggtaacaaatacaatatcttgcggcgtaccgggcgacgctcgaacggatggcgcatccatgatgatgccgcttgatccggcatcccgacacacggcctccgaacacgtcggtttgcgtgctgcaggaggaacctcgtgctgcgcttcgccgtctcaacgcgaccggcttcatctcccgcagtccaatcccctgatcccgcagcacccggagagaaacatggcacaccgccccctcggcacatcgaacatccaggtttcgccgctcgcgttcggcggcaacgtcttcggctggaccgtcgacgagaacacgtcgtttgcgctgctcgacgcgctcgccgacaccggcatcaacttcatcgacacggccgatgtctactcggcctgggccccggcaacagcggcggcgaatcggaaacgatcatcggcaagtggctcaagcgctccggcaagcgcgagcaggtcgtgatctcgaccaaggtcggcctgctggccgcgcgcggggctgacgaaagacaacatcctgaaagccgccgacgattcgctgcgccgcctgcagaccgactacatcgacctgtatttctcgcacagcgatctcgccgatacggccccgctcgaggaaacgctcggcgcgtatcaaacgctgatcgaagcgggcaaggtgcggatcatcggcgcatcgaactacagcggcgcgcggctgcgcgaagccgccgacatcagccagcgcgacggcctgcccgcgtaccaggtcatccagcccgaatacaacctgttcgatcgcgccgactacgaacgcgatctcgaaccggtcgtgcgcgacctgaagctcggcgtcgtcaattactacgcgctcgcgagcggcttcctgtcgggcaagtaccgcagcaaggccgacctgaagaagagcgtgcgcggcgaccgcgtcgccggctacctgaatgaacgcgggctgcgcatcctcgcggcactcgatgcggtagccgcgaaacacggcacgcagccggccgcgatcgcgctcgcctggcagatcgcgcggccgacaatcaccgcaccgatcgcgagcgcgacgtcgctggcgcagctggaatcgctcggcgacgcaatccgcgtcacgctcgatcaggacgacatccgccggatcgacgaggccagcgcggcctgaagtcgtcggcagcgggccggtcgaccggatcgcgcggcccgcgcggttccgcgaccggcacgtgtcgcgtgcgcgcccttgtcaccgcatgcgcggaggcagggcattcgggtgaggcggatggatacaatggcggcgcacgggcggcccgccgcacggctcgacacggccggaccgatatccgtgacgcccggccccacaccacgcacaaaaacgcccatgccccggaacacccgtcgcgcccgctacgcctgcccgttcgccgccatgctcgccgtgccgttcgcctgcgcgccgaccgcgtcttatgcaggctggtacgaggtcgtcaactacaccggcacgatcggcaccgcgccggtccacgtgtcgctgcagacctacgacgcaatcaaccgcaacgacgcgggccgctggcgcgtcgacggcagctactactacgatgcgcatcgcaagccgattccgttgcagggccgccgtgagcccgatggccgcatgacgctgtgcgaagcatcgccgccggcatcgaacgccgactcgccggtcgtgcccgccgcatcgccgtcgcggccgaagccctgcccgatcgcgctgaacgtcgccggtcaaacggcaaccggcacctgggacgacggccgcaagacattacccgtcacgctgaatgaagtcgggcgactgaacgacaacgatcaggatcacgtccggctcgacggcaccgtcgacattccgatgtggtatcgcacgaagacgcacatgctggtcggcgtctatgcgctgtccgacaagtgcggcctcgcgatgcagtcgctgcgggccgtgaacatcgcgacgggccgcatcgaccgcacgatcgcgctcgactgcgacgccggaatggtgatgacgtcgatctacgcgaacgtcaccgacgcgcggcgggccggctacgtcagtgtcgagtaccgcggcggcaagatgggctacgagcaggacgtgtcgctcgggctgccgtcgtctccgtcgaagtaacccggcacgacctaacccgaaatcgcacacgtgtcttgactcacgcagccgcttcccttgactcggccggacatcgatcgcgcctgcgcccgccatgccccgctgcaagggcgtcacaggcgtgtcccgggtctttcacggattgaccacgcgctccgacgtacccgagactgcgccgctcaggcggtcatcgggagaacgtcatgccggacaccagcacggagatcgccacgatctcgacgcgcgccgtgcgcggccacgaacgcgtcgacttctgggtcgaccatgtggcgcgcacgctcgtgcggatcgaatgcagcggcaagtcgtcggaaggcatcgacgcgacactgcgcaagcgcgatctcgggctgttcggcgcctgcgacatcgtcgcgaaccggcacgcggtcgtgcgcacgccgcacaacatccatgcggaccagcgcgatgccgtgttcatctgcctgatgcacgcagggcaaggctatacgttccaggacgtcgactgcatgcagcacgggcccggcgacctcgtgctctacgacacgtcgatgccgtacggccacggttttcccgccgacatggcgatgaccgtgctcgacgtgccgcgcgacgtgttcgaggcgcgcgtcggcccgtggcgctaccgcagcctcgtcaagatcgaccgtgacgacggcgtcgcatcgtgggccgtgcggcaggtgtatgcgctgctcgccgcgccgcaggagccgacgaccggtgcgcgcgaacggcgcgccgccgcgatcctcgatctcgtgcagtcgatgctgcggctgcgcgacggcgacgcgtcgccgaccaagtcgaccgtccacacgctgtcgcgcgcaaaagcgttcatcgacagccatctcgccgacgacgatctcgacagccagtcggtgagccgcgcgatcaacctgtcgccgcgccagctcgcgcgcgtcttcgagatcgaaggaacgccgctcacgcgctacatccttgcgcggcggctcgaacgctgccgcgccgacttgcgcgaccggtcgctgaagcacctgacggtcagcgaaatcgcgttccgctggggcttcaacaacagcgcgcacttcagccgcagctatcgcgcgcgcttcggcgagacaccgagcgagtcgcgcgcgtcggcgccggcgccggccgacgcgcggtagcccgccaccgtccacccgccgccgtgtccctgcgaggcaaacaccacgtccgtcccggtcaaacggggccgcatggcggtcgctaagctggcttcctgcgcggcggcactcgtttcgccgcccgactgcaaggagaagaagcgggatggagacgtacgaccatatcgtcgtcggcggcggctcggccggctgcacggtcgcgcaccggctggtgaaggccggcaggcgcgtgctgctgctcgaggacggcccgaaggacgacagcctgttcatccggataccggcgacgttcatccgcgtactcggcacgcgccgcacggtcacgttcgagagcgagccgcaagccggtgcggcgggccgcaagacctacgtgccgcagggccgcacgctcgggggcggcagttcggtcaacgcgatgctgtacgtgcgcggcacgcgcgacgactacgacgactgggccgcgctcggctgcacgggctggggctgggacgacgtgctgcccgtgttcaggcgcgccgaatcgcacctgcggctctccgagccgtttcacggcaccgacgggccgctgaaggtcggcgacacgcgcttcaggcatccgctgagcctcgcgttcgtgaaagccgcgcaggaaaccggcatcgcctacaacgacgatttcaacggcgccgcgcaacagggcgtcgggttctaccacacgacgatcttcgacggccggcgcggcagtaccgcggccacctatctcgccgacgcgctgcggcatccgaacctgcgcgtgctgaccggctgccgcgtgacgcgcatcctgttcgacggccggcgtgcgaccggcgtcgaatggcggacggcaagcggcgcgacgggttcggccgccgcgcgcgccgacgtcgtgctcgcagccggcgcgctgagcacgccgaagctgctgatgctgtccggcatcgggcccggcgcgcacctgcacacgcacggcatcgacgtgctgcacgacagccgcgacgtcggcgcgaattaccaggatcatctcgaagtctcgatctacggccgcagccacgcacccgtgagcctgctgggcgaggatcgcgggctgaaggcattgcggcacgggctgcagtggatgctgtgccgcacgggcctgctgacgtcgaacgtcgtcgaatccggcgcgttcgtcgacacgaccggcagtggccgcccggacatccagttccacgtgctgccgacgctcgtcggcgacgtcgatcgcgagccgctgcccggccacggcctgtcgatcaacccgtgcctgctcaggccgtgctcgcgcggctcggtgcaactgcgcggcaacgatccggccgcgccgatcctgttcgacagcggcgcgctgtccgacccggccgatgtcgacggtctcgtgcgcggcgtcgcgctcgcacggcggatcatccgcgcgccgtcgctcgcgcgcatcgtgcgcgaagccgagacgctgaccgatacggcactcgccgactacgtgcggcgccgcgcgaaaaccgtctatcacccggccggcacctgccgcatgggcaacgacgaacatgcggtcgtgacgccgcgcctctcggtgcagggcgtcgacggcctgcggatctgcgatgcgtcggtgatgccgcgaatcgtgtccggcaacacgaacgcgccgacgatcatgatcgcggagcgctgcgccgaattcatgctggcggaatgacgcggcgcggcgcatttgcgccgtcgttcgctgcacgaaaaacggcgcgtgggacacgcgccgccgctccatccgtatcgactgccggtatcagcggccggccgcgtgcgccgcgtcgcgcaacgccatcggcgacgcgccgtagcgctcgcgaatcgcccggctgaagtgcgcctggctcgagaaaccccagcgaaacgcgatctcgccgatgctcgtcttgcgcagccgcgcatcggtcagctcgcgatgcgcgtgcgccagccgctccgaccagatgtgctgcgtgatcgactcgccttcggccgcaaagagccggctcaggtggcgcagcgacagcccgaccgcgtcggcaaccgcctgcggcccgagctccgggtcgcccaggtgcgtcgcgacgtactgcttcgcggtcagcaggtacgacagcgacgcgcgcgacgcgcccgcgccgttcacttcggcgtcgacgagttccgcgatcagcgtgcgcgtgtgctcggcgaatcgcgcggcatcgcgctcgaccgggtccttcatgaaccgctcgacgcttgcgcgcaacgtcgcgccgagcatcgcgcccgcgcccggcttcggcgcgatccgcagcggcagcgccgccagttccgcatcgagccggtcgtcgagcgtcgtgaccgggatatcgatcagcaactgccgcatcggtgtcaggaatccgaacagataaggcacacgcgtgtcgtagacgacgacatcgccggcttccgcgagcaggcaccggtcgtgctggatgaaatacgcacgcccgctcaggatctggcacgcgaacaacgactccttcggcaactggcgcaccagcgcggggctgcgttcgatcacgtgatcctggccgctgatgtcggcgatgccgaggcccggcagcgcgatgtcggtcttctcgacctcgagcccggccggcgacagcgacgagcagcgcaggccgaccagcgtctctgcattgaacgcgtcccagtacgccatccggtcgcgcaccggcacgtcggccgtcgagcctcgcgtgcgtgaaaaacggtcgaattcgtcacgtcgcctcctgctggcgcccgtcgtgcggagcgccatgcaatgcgaaattggggatggatcgtttaaacgtcgtgcggtgcgatgtccggcccgatcaagcaattcgtccagcccagtcaagagcggcgcgcacctgctggctaaagtcgagcccacgacatccaaacacaaggagacgaaccgtggtcgaccaagccgtagccgaattctggcaaaacatcccgccgattgccaatccgttcaagcccgatgcgcttccggaagcctacatcgcgaacgcggccaccgacgacgagcgctattacgttccgttcaccgaaacggtttcgtcgcggccgctgtggatctcgccgtcgcagaacaaatggtgcgacatcctgatggcgaaggaagccgggctcgtgaaccggcactatcacccgcacgaggtgttcgcttacacgctgtcgggcaagtggggttatctggagcacgaatggaccgcgacgcgcggcgatttcgtctacgagacgccgggcgagggccacacgctcgtcgcattcgatcaccccgagccgatgcgcgcgttcttcatcgtcaaggggccgctgatctggctcgacgacgaaggccagcccgacggctatttcgacgtgcactcgtacatcgcgatgtgcaaggcgcactacgagaaggtcggcatcggcgcgcaagcgatcgagaagctgttccgctgacgcgcggcgaggctcaccatgacatccccttcctcctccaggcccgcctggacgtacgagaacaggctgctgctgatcctgttcatgacgttcggcttcgtgttcttcgaccgcctcgcgctgtcgttcctgttcccgttcatgtccgccgagctgcacctgacgaatgcgcagctcggcatggtgtcgtccgcgctcgcgctcacgtgggcgctgtcgggcgccgcgaccggcgcgtggtccgacgcgcgcggcacgcgcaagccactgctgatcgccgccgtgatcggcttttccgtgtgctcggcgctgtcggggctcgtcggcggtttcgcgagcctgatcgcgttccgcgcgctgatgggcatcgccgaaggcccggtgctgccgctctcgcagtcgctgatggtcgagagttcgacgccgagccgccgcgggctgaacatgggcctgctgcaaggctccgccgccggcctgctcggcgcgatgatcggcccgccggtcgtgatcggcatcgcgaccgcgcacggctggcgccacgcgttcttcgtatcgtgcattcccggcttcctgatcgcgttctgcatctggcgctgggtgcgcgaggtgccgcccggcggcgcacggcatgcgcaggccgacaccgtcggcgcaccggccgcgggcggcgcggcgatcagccgctgggcgctgctgaaggaacgcaacatcctgctttgcgtgctgatcagctgcttcttcctcacgtggttcatcgtgatcatctcgttcgcgccggtgttcctcgtcgacagccgccacctgtcccctgccgacatgggcgtcgtgatgacctgcctcggcgccgcgtgggtgttctggggtttcgcggtgcccgcgatctccgaccggatcggccgcaagccgacgatgatcgtgttcgcgctggtcgccgccgcgtgccccgtcacgatgattcacgcgaattcgctgtgggcgctctgcgcgctcgtgctcgcgacctacacgggcctcggctgtttcacgctgttcatggcgacgatcccggcggaaacggtgccgccgcgcgcaatcgccagcgcgctcgggctgatcatgggcgccggcgagctgatcggcggcttcgtcgcgccgaccgtcgccggcttcgccgcggacaagtacggcctgcagttcgcgatgtggacgtcggccaccggcgcgatcctcgcgtgcgtgctgtcgttcggcctcgtcgaaaccgcgcccgccgtgctgcgcaagcgcgcgctcgccggcacggccgcgaaccgtctcgatacacagaacctcggaggacgctgacatgcgtgcacttcaatggcatggcccgcgcgacgtccgtctcgtggaaatcgatacgccgcgccccgggccgggcgaggtgcgcatcgcggtcgcgtattgcggcatctgcggcagcgacctgcacgaatacgcggacggcccgcacgcgattccggtcgacacgccgcatccgctgtcgcgccgtaccgcgccgctgacgctcggccacgaattctgcggcaccgtcgtcgaagtcggcgaaggcgtgacgacgctgattccgggcgattgtgtcgccgtcgagcccgaatatcgctgccaccagtgcgcgtactgccgctcggggtcgtacaacctgtgcgtgtcgatgggcttcgccgggctgatgggcgacggcgggatggccgacttcgcggtcgtgcccgcctacatgctgcaccggctgcccgacggcgtgagtctcgagcaggccgccgtgatggaacccgcggccgtcgcgctgcacgcgctgcgccgcgccgagctccggctcggcgacacgtgcgcggtattcgggctcgggccgatcggcctgctgctgatccagctcgcgaagctgcagggtgcgacgaccctcgtcgcggtcgacgtgtcgaccgagcgcctcgcggccgccgcgcgcttcggcgcgacgcacacgttcaatgcgcgcacgctcgacgcgtccgtgctgcgcgatgcgatccacgaggcatcgggcgggctcggcgtcgacgcgagcttcgaggcggccggcttgccggccacgttcgaagctgcgatgcaggcgctgcgcaagggcggccgcgtcgtgatggtcggcctgatgccgcaggcgggcttcgacgcgttccgcgcggtcaacgacgagctgaccttcacggcgagcgtcggctaccggcatgcgtacgaggacctgctgcgcatcgtcgcatcgggcgcgctcgatctcacgtcgatcgtcacgcgcaccgtgtcgctggaggacgccgtcgccgacggcttcgacgcgctgctcgccgatcgtacgcagatcaagatcctggtttccccgcgcagcggcatgcgcgctccacccacgccgtcgagagtgtcgaacatgagtcgccagtggttatttgaaggaaggaccgtcgccgtcacgggcggcacatcgggcatcggcgcaagcacggcgtggcgtttcgcggaagccggcgcatcggtcgttgcgctcgggctcgacgctaccggcccgcacgcgccggtgcatccgcgcgtccggtgcatggaactggacgtgaccgacagcgacgcactgacacgcacgatcgccgcattgccgcggctcgacgtgctcgtcaacggcgtcggcatcagccggcacgcggacgaataccggatggaccagttcgaactcgtgctgaacgtgaacctgacgtcggtgatgcgcgcatccgacgccgcgttgccggcgctgtccgtacaaggcggcagcatcgtcaacgtcgcatcgatgtacacgtacttcggcagcaaggatcgccccgcgtacagcgcgagcaagggcggcatcgcacagctcacgcgctcgctcgcgcaggcgtgggccgatcgcggcatccgcgtgaacgcggtcgcgcccggctggatcgacacgccgctcagcagcggcctgatggccgacgcgcaggcgtcacgacgcatcctcgaacgcacgccgctcgggcgctggggcacggccaacgaagtcgcggacgtgatcctgttcctgtgctcgcccgccgcgtcgttcgtgacaggtgcggtcgtgccggtcgacggcgggtattcgacggtctagcgcgcgctcgacaggcatcggccggcatcggcgggcacgcggttccagccgatgccggccgatgccagccgcacaccggttcgctccggttgccaccgaaccggcaatcgcccggctcgggtttgttcatatcaatcagtagtccaattaaaaatatccggcctgaccggaaacatgtgaggagcacattggagatgacgaaaaagacccttctggcgctcgcggcatgcgcccttcccgccgtgtcgttcgcgcagagcagcgtgacgatgttcgggctgatggatgccggcatcagctacgtcagcaacgaaggcggccacggcaacgcgaagttcgacgacaacatcttctttccgaacctgctcggtttcgaaggcaaggaggatctcggcgcgggcacgcgcgcgatcttccggctcgtgaaccagtattcgctcggcaacggctcgatcatcggcggcgggctgttcgctcggcaggcctacgtcgggctggagaacgatcattacggcaagctcacgctcggcaaccagtacgagttcatggtcgatgcgctcgccgccggcggcaacgagatcgcgcaggatctcgtcggcctgtacggctttcgcaacgggccgttcgacaagctcgccttgccgaacaacccgaccggcgcgttcgactgggatcgcgtcgcgggcagcaatcgcgtcgcgaattccgtcaagtacacgagcccgtcgctgtcgggcctgaccttcggcgcgctgtacggtttcgggaacgtcgcggggtcggtcggtgcgaacaacacggtcagcgtcggcgcgagttacgacaacggcccgttcggcgcgggcgcggcctatacgaaccagaaatacggcgcgtcggcggggctcccgccgaccagcgtgcgcaactggggcgcaggggtgcactacacgctcggcacggtcacgggaaggcgctcgtgacgaccgtacggaactcggcgaacggcgcgggcgcgtggtcggcggaagccggcgcgtcgtggcatccgtcgcctgcgtgggtggtcggcgcgagctacacctacatgaaaggcaacgacacactcgacaatgcgcacgcgcaccagttcctggcggccgtccagtactggctgtcgaagcgcacgatggtgtacgtggcgggcgtgcatcagcgcgcgaaccacggcagcaacgcgcagatcaacggcgtgatggacgcgaacggtgcgtcgagcggcgcactgcagtcgatcgcgcgggtcggattcagtacgcggttctgacacgcgcggcggccggccgcgcaacccgcgtggccggcccgaagctttcgttgcggcacacgctcggctgcaacgacttcggtacgacgagggtcgacttcacgtagaaaacgtcgcgcgcatcacggccgcgcccccggcctgtcgcccgaccggccggcaagcgcatcgaacgtatcgaggcgaacgcgccgcaaccgaccatgcgccgcagaaccggatccgggcctaccggctgcaagcaaatgtgagcgggcgcgccgcaaccgggccggcggccgcgccttgtcgcgcatcccgtcagtcgccgtccttctcgagcacgttctgcgtgagcgcgaccgacggaatcgtcggcttgagcgacgcgcggtgcgcgcggccgctcagccacttccagccggccacgagcaacagcgcgacgagcgggatcgacgcgatcgtccacgtgccgttcggatagtcgaatgccatcaggaccagcacgccgagcaggaacagcagcgtcagccatgacgtcacgggcgcgccgggcatcctgaacgacacgtcgtccacctcgccgcgcgcgaccgccgcgcggaacttcatctggcacacgacgatgaatgcccacgtactgatgatgccgagcgacgcgatgttcagcacgatctcgaacacgctcgacggcaccaggtagttgagcagcacgccgaccacatagatcgcgaccgtcacgagaatgcccgcgtacggcacggattgcccgctcatcctgccgaggaacgccggggccgagccgcccattgcgagcgaacgcagcacgcgcccggtcgaatacagtcccgaattgagactcgacagtgccgcggtcaacaccaccaggttcatcaccgaaccgatgccgggcacgccgagcgcgccgaaaaacgtgacgaacgggctctggccggccttgtacgcgctccacggcagcagacagaccagcaggacgaccgacgcgacgtagaagatcgcgatgcgccagatcacgttgttgatcgcgcgcggcagcaccttgcgcgcgtccttgcattcgccggcggcggtgccgaccagttcgacgcccgcgaatgcgaacaccacgccctgcaccagcaccagcgccggcatcagcccgtgcgggaagaacccgccgttgtcggtgatcaggtgcatgcccgtgtcatggcctgcgacgtgcccaccggtgccgaggatcacgctgccgatcacgagaaacagcacgatcgcggcaaccttgatcaacgcaaaccagaattccatctcggcgaaccacttcacgccgatcaggttcatcgtcgcgacgatgcacagtgcggcgagcgcgaagatccactgcggcacgcccgaaaacggcgcccagtaatgcatgtagagcgcgaccgcggtgatgtcgacgatgccggtcatcgcccagttcaggaaatacatccatccggcgacgaacgacgctttctcgcccaggaattcgcgcgcatacgacacgaaactgccgctgctcgggcgatgcatcacgagctcgccgagcgcgcgcaggatcaggaaggaaaacacgccgcacaccagataaacgatcgcgagcgacggcccggcagcctgcaggcgcgcgcccgcgccgaggaacaggccggtaccgatggcgccgccgatcgcgatcatctgcacctgtcgattgccgagggtcttgtgatagccggcctcgtgggattcgagccagttccgtttgctggtgtcgccggtcggcgcgggttcgggaatcgatgccatgactgcatcctcgtgtgcttgcgtgatctcgttcggaccgtaccgcgatccgggcccgtcggcgcctgcggccgtgcgacgcgccatcacgccgcgcatcgaggccgctgcgcgccggacatggcgcgcggcaccgtcaaccgcgaacgtatgcagccgtaattccgttcacaaacgctatgcaaatttcgactgtcccggcatcgaatcgcgcatgcgacatggatggaaagcattttgaaatacgtcaggatttcgaaagacgaaagcgggagcacgagatgaaactacgcctcgaccgacgtcgcgcccggaacccggcgccactggcggacgagcggccaagtcacggaaacagcagtgccggattcaactcggcttcgctgcgtgaccgggcgcacggcccaagatccaccggcaccgggtaaagccgtcgtgcaccaaaacgcggccagagatgacacagcgcccctccacctcgacatcgaacaactgattggcttcggtcagcacacgctgcgccgcgattcggccatccggacggaagccgaagccgatcgaaaagcgcccgtcctgcggattttccgccggcgcggccaccgtcggcacctcgagatcggtggtgatgtcgagcgcccgcaaacgcccccgcacacccgcgcgcgcgaagtgctccgcgacgccggacgcgtgcgcaccggcgccgcggccggcttacgccacccgcgcgcggccaacgcgtgcctggttgccgcgccgcaggtcgggcggcatcgacgcatacgctgcatcgcgaatcaacgcatggcggaacgaatagaccacgcgatcgcgccgatgttgcgcgtacaggatccgttcctcgagcagcaactgcaggtgcgcgtcgagcgtcgcgcgatcatgcggcgaagccgcgacgagcagttgcgcatccacctcgagcccgatcgtcgcggcgagctgcgcggtgtcgcgcgcgtcgtcgatccggtcgaacgctcgaccgagcatcccgccgagactgagcggaagcggacggggatccgtcgtcagcagcccggcgagcgtgccgtccgcgccgcccatcgtcagctcgcgcgcgacggcctcgatgaacagcggaatacccgccgtgcgccgggcgagcggggcgagccagagcggatcgagctcgcccgggcccaggcatgccgacatcaggtgctgcgcgtcgtcgcgcggcaggcggcgcaacaccaggcgttcggtcgcgccgcgccagcgcgcgagctggtcggggcgcgacgtgagcacgatgccgagcgccgccgcgcgcggcgagcgccgcaggtacgcaagaaaatcctcggtcgagcggtcgatccactggacatcctcgacgacgaacaacaccggcgcgccattgccgagcgacacgatcaactgctcgagaacgtcgaacaatgcgtgttgttcgcgcgcactcgaccatgggaccctcgtcccttcgcagggcacctccagccaggtcgcgagtgcgacacgggccgccgcgtgatcgcattcgagcggcgcgatcatggtgtcgatcgccgcgagcgcgagatccgccgggtcgtcggcgtcgatatgccaatgcgcggcgatgaatcgcaggatcggaaacagtgcgtgattctcccgctcgggcaggcacccgcaatacgcgcaggcagaaccctcgccccggacggcctcgcacaactcgtgtacgaggcgcgatttaccgagccccgcgtcgccgacgaccagccgcggcacaccgtgcggcgcaggctcgccgcgcatcacgcgacgatgtcgtgcgagcgtctcctgccacgcgcgcaggagcacgtcgagttcgcgcgcgcggccgaccatcggtgcccgcatgccggcgtcgagcgaatcgaacggcgtatcggcgcgccgctcgccgagcaattcgtgaaccggctgcggcacgaggcccgcctgcgcgagccgcaacggagtcggccgacagtccgcatgccgttcgagcgccagccgcgcatcgtcactgatcagaatctgtccgggccgggcaagccgcagcagccgcgcagccgcggcaggcgtcgatacgcccgacatatgcgacgcatgggcgagaacctgcccgacgtgaatcgcggcggccacttcgacgcgccagcttgcaccagcggcttcgccgccggccgccgcaggcaccggcagccgtgcgcgcccggccacccgtaccatgtcgagtgccgcgcgcgcgcgcgcgccggccaatcgatgtcgccttgcaggccgaaatggaacagcagcgtgtcgccgagccgtgcgtcgacctgcgcgccgtatccgacggcgatatccgcgcacttcgtctgccattgctcctcgtagccgtcgagcagggcgtcgtgatcgaccccggcgtggcgtcgccggccttctccggtgatcgtcacacaacagcacaacgtggtgatctgacggtacccgcccgccgttgcgatcggctcgccgtacggcgcgaacgggcgcggatgcgtcggcccgcttgcgcggccggcatcgaaacggccgacgagcgccgcgaagttgagcgtgcggaacgcttccgcgagttcgtcggccgacgcggcgcgctgctccggattcttgctcagcgcgcgccgcaataccgcgccgagcggatgcgatgcgatcggcggagggaacgcgacattcgccgggctgagctgctgatagagaatgtcggccacgctcgcgccgcgcatgacgacctcgcccgtcaggcattcgatcacgaccaggccccacgcatacaggtcgcttcctggcgtcggcggctcgttgcgcaattgctcgggcgcgcaataggacgccgagccaagcacctcggtcgccagcgtcagggtctggcgcccgatgtcctccgcgccgggcagcaacgcaccgatgccgaaatcgaggagcttcgcgtgcggcccgtcgtcggccatcgcgatcacgatgttttgcggcttcaggtcccgatgcacgatgccccggcgatgcgcggccgcgagcgcgtcgagcacctccgccatcagccggcccgtgtcgacggccgacagcggccctgtgccgcgagccggtcgcgcaaggtccggccctgcaccagctcgaatacggcgaacagccggccgtcgggcgcttccccttgtccagcaaggccacgatgttcgggtgccgcagcgcctcgcacaggctcatctcgcgctggaagcgcgcacgctggcgcgcgcgctccgtcgcggtccgcacggcgtgatcccgcatcagcttgatcgcgacggcttgtcccgtttcgcagcaggtcgcgcgaaacaccacgccattgccgccttcgccgagcaacgaaccgagccggtaacgccgcttgccggccagttccgcaaatggcgcgagggcacggccggcgccgagaccggttctctcgagttcatgagcaatggactaccggggccggcgccggacgatgcacgccgatacgcggctgagcgggcggcaccgactggcattcgagatgcgcgccgcgcatgacgcggaacgggaaatcgccgaacctgacgctgccgcgccggcgctcgacgagctggctcgcgcccagcccggcagggccgcgaactggctccgggcgcggtgaatctgcacgttgacatgggacgtatcgatgccgagcatgcgcgccagccggtcgagttcgatccagccttgcgtggcggcgtcgtagccggcctgcatgtcggccgagcgcgcgcgggcaagcgtgacgagactgtagtgatgcgcgcgctcgccgaggtcgaccacgccgccgcgaacatgcagcagcatgcgcacatgctcttcgtcccggctgacaaggaattcgagcagttgtgccggcacggccggatcggcgggggcggcgagcctcatcgtcgaaccattgcgcgcgagtgccaggcgccacgtggcgtcgccggtcgatacttcgtcgccgtcatggagcgcgcgcggcggcaacgtgtcgtcgcacagccattcgccggccggcgaccggacgatcgtgaccggctgcgcggcgcgtgcggccaggatctggcgcggcgcgagcacgatcggatgcgcagcgcctcgtatcggccacagcgtatcggccggatcgtcgagcgcatcgacgcgccacggcgcgatgccggccctgccgaaccggatcatgtcacccggctgcagtaccgcgtgatcgccgtggcgtaacggcacgccggacagcgacgtgccgttgctgctgtgatcgtggagttcccacagcccgcccacccagcggatatgggcgtgaacacgggacaccgacgcatcccggatgaccgtatcgcaacgcgcggcatcccggccgaacacgtgatacgcgcggagcaggcacgcttccccggaagaatcgttcatgagtgtcgccatggctgccccgtatcgaatccgcccgggtcgctcgagtgacgcatcgacgcccaggcaaacgattgcttcaatgaacgcgaacgatgtcgcccgttcgccgcctcgtaatccgtttcttcgtcagcttcctttcggatcgttgctcatccggcacgtgttgtttcgactgattgaatggccggctgcattgttgtcttgaaatcgagcaacctgatgaaaatcctgccaaataaaatcatgcatcgcaatcggaatactcaactctctccttgatattgcaatgctttacattttcgaccgatttttagatcgcatataaagggtcgtaaattcgaatcgcctctagatccccgactggcttgcctgaaacggacgcagccacattgaatgacgaggcgaacttaaatacctttgccggcgcggatgttttgtttgattaaaaggaaataaattaaatagtttcggcgatttaaataattaccctcgatgttttggcgaattgcattacaagagttactgcgggattaaggtgtcgcatccgatgtttcgggggtgtcggcgggcaagcgggtaccggcacgccgccgcgtcacgatcgattgccggcaacggctggacgcaggcaaggcgtcgacgatccgatcgccgtgctcgctccgccaggaggccgatggaacccatcggcaacaaccaccgccgcaagcggcaggctcgcaaagaaacggggccgctatggcccatgcagctcacggcttgatcatctggcctgcgcgtagcaacaccttgccggggagaggtcgcgcggcaactccgattcttgcgagggaacgagaatgcgccgtcgtgacggccggtccgttttatgagcgcacggcactgcctcacgcacgatccaggttcccgatcaccttgaagtcaagcgcataccgcgttccgcgaggttggcggggcgaaccgcgcaatcagtttctgccgtcccggatgctcgagatgcccggtgtttggcggcgcaaagccgacagaccacatgtccgaaaatggcgcacgtcgtgggcgcgcgggatatacgatgtcacccatgcctacccccatcgacacccccgacagcgacgcctgctacctggcgctgaaggcgcacgacgcgcgcttcgacggctcctttttcgcggccgtcaccagcaccggcatctactgtcgtccggtgtgtcgcgtgaagacaccgcgtcgcgagaacctccgcttctaccgtcacgcggcagaggcagaagcggccggtttcaggccctgcttgcgttgccgccccgaattggccccgcgcgcgacatcctggagcacggaggacgcttcgcgcatcctggccctgcaggccgcaaggttgatggacgaacccgacgcatggcggcacatgacctccgcgcgcccgaccttcaggcagtcgagcggcggcttgatgccgcgcattgcgcaacggctgggtgtgaccgaccgccatttgcgccgcattttcgacgcacactttggcgtgtcgccgcttcagtaccttcaaacacgccggctgttggcggccaagcagttgattgccgacacccgattgccgatgagccaggtcgcggcgtccagcggcttttccagcgtccgacgcttcaacgatgccttctcgcgccattacggcctgaatcccagcgccttgcgccgggccagatccgcgtccgatggacaaggcgtgaccgtgcgactcggctggcggcctcctatgacgtacaggcaatggtgggcttttgcgcctgcgcgcgttgcccggcgtcgagcaggtcgcgggcctggaatacacgcgaacgctgcggcttgtgcaagggacgcaggcgcgtagcggctggttgcgcgctcgcttcgacgaagatcgcgcgcaggccgtgctgacgatcagcgattcattggccgccgccctgccggcgctgatcaaccgtgtgcgcgccgcgttcgatctggacgccgacccgatcgccatccacgcggctctgcacgccgcgttcccgttgggcgaaggcttgcgcgtgccgggcacactggacggcttcgagcttgcggtgcgcgccgtgctgggccagcaggtcaccgtggccgctgcacgcacactgggcgcgcgactggttgcggccttcggcgatccgatcgaaacgcctgtcgcgggtctggatcgtctctttcccacgcctgctgccctggcggccgccaccggcgatgagctcggccgcctgggcatcacgcggcaacgccagaccgcgctgcatgcgctggcgcacgccgtgcaggacgggcgcatcgctttgcatcccggcgtagacgtcgctgcgacttgcgccgaattgtgtgcgttgcccggcatcggcgactggacggcgcagtacatcgccatgcgcgcgctgcgttggcccgacgcctttcccgccggcgacgtcgcgttgcaaaaagccctgggtgtaggtagcgcccgtgccgcggcacaagccgccgagcaatggcggccctggcgcggctattcggtgctgcgtgcgtggcacgcgatgaatcacggtgcttcggcctgactacgactcatatcgacacctttcccggccgcgtgactcgtcaccaccggaagcgaccaacttgcacgatgaattcaatcacacggatcccgggcacggcacctgctcagagcgatttgttcggaagcagcgacgccgaattctcgatagacgagtcctttcgatcggcaaggcgtttcgatctcgacgctcattcctggatcgacatcgtgcccggatggatttcaggggcgtcgcagctctatgagcagttgcgcaacagcgttccgtggctggagcacgatcggcgcatgttcaaccaggtgtttcgcgagccgcgcatgacggcggtctacaagcatgtcgccgatgtgcccgacgcgcgcctgctgcaggccgtccgcgcgctgtcgcgtcactacggcgtggaatacgacggcctgtggatgaacctctatcgcaacgggcaagacagtacaggctggcatcgcgaccacggctcgtgccggaagctcgactgcatcgtgcccgtcctgacgctcggcacgatacgccggttcctgatcaagccgatcaagggcggccgctccgtgaccttcaaaccgtcttccggagacttggtggtgatgggagggcgcgcgcagcaagactgggtgcactgcgtgcccaaggaaccggaaatcgagggcacgcggatcagcgtcaacttcatgagctcggcgcagggcgtgagggattagcacgcgaagccgccgaggtctggcgacgctgtgaacagctcgtatcgaagggacatgcagagaacgtaccgctacatcacatcgctcaagacaggcaccatcggttaaggcaaagcacacccgttgcgagtctcccaaattgtggcgaccctcatgctgtagtcggcctatgtccggcgacaaaagacagggcaacgggtattgaataaccaacgctgggatcagcggtatcggccgcttgtagtgattcgcgatcgctttgattccagtattcgcagaccgtatgtggcggcctgagagaccgcgtacacggaagtttgacgtcatgcggagcagccctccgcaaacaccaccctcggtattgagcgacatcgattccgctacgcgtacttgtcgccgaccgtactacgaatcggatgggtgtcgtagacgatgatcatccgttcgatgagccccgcgatgtcgaactcgaacacgtcgacgcactcgaagcgcaccgccgatccgtctttcaggccccagtcgtagatgaagtaacctgtcgcacgtcgagccccactcgcgctgacgcagatatcgatcggtgtaatcttgctttctcccgacgcggcagcgaccttcgaaaaaaaggcctcaggatgcatccagccgagaaatggcgaaaaatctgcgcgtccggcgtaaatagcgcgcagatggcaccgacatcgcctcgctccagttcccgaaggtacgcgcgaacctgttccgtatatagtgatcccgacgttgagtccaaaattatcctccgatcattcgttgacaaccccgttcattcgcaagaacagggcatccggtagacgcacgatagcgacgcaccgatgaccgaacaatcgaaaaatgtgcaatccgggtatgcagcgcatgcatatccgctggctgacctgacacggcccctcccaccgttggcagcgattcagtcattcgtcgccgcggcgcagcttggcagcgtcagcaaggcggcggctcatctatgccgtacgcaaggcgcggtgagccgccagatacagcagttggaaacgcattatcgatgcgcgctctttgtgcgccacgtatcgggtctgacgttgacagcagaaggaaatggactgctgacggtcgcggtcaacgtgcttacgcaattggttcagcacgcagacttccatgcgcggacgacctcggttctcaccttgaagttgccgtccacgttcgccattcgctggttgctcccgcggctgccggacattcatcgcgccatgagcgggacggagcttcgtatttcgacatccgcggacgatacgccggatttcactacgtccgacgtcgatgccatcattgtgcgaggcacgggacagtggaccggtatggaagcggtaccgctgttttccgagacgctcacgccgatgtgcgcgcccgcattggcaacatcactgcgatccgttgccgaccttgcgcatgtcgatttgctccatcccgggcccagccacgcggagtggagatgctggctcgatcatgttggggcgctccagatcgatgcagaacgtggacttgtattcgataccctcgaattgacgctcgcggcatcgatggatggacacggaattgcaatcggcgacccacgaatggcacgagaccggctccgtgccggatcgctggtgacgccgtttgaggacgtggttcaggacggcctttcctacttcctcgtatatccgtcccaacgcgcggcacaaccgaaaatacgagccctcgccgacatcttgctgcggcttgcgcgagaagactgatcgataggcgagagtccgatacccgggcagggccgacagtcggatgttgcagccgaagtacaggcgaatgacaggatcgggtcatgatcggcaagctaccccacctgctcctttcccgtcgcgccagtttggtcaacgcttgtggacaaccgaatcgagcacgaagctggtcgtcatgttctgcacaccgtccatcgcactgatcgtcgcccagatgtcgctgatgcgctcgtgtgtggcggcctctatctgtacgagcaaatcgacctcgccgctgagcaccgcgcaatcgcgcacctcggcgatccgctcgagtgcggcaagcacgtccgcaccgcgcatccggtccttgcggtaaaccagcatcacggcgcgcaccggcacgacctcatcgggcaatgcgagccgcaccgtatagcctgcaatgatgttcagtgcttcgagccggtcgatccggttccggaccgcttgcctggacaaaccgatcctgtcggccagcaccgcgagcggaatccgcgcatcggcacacaacgcgtcgattatcttctggtccaggccgtcgatcttcattcgccgagcccggtgtgccgggcaccgcgtgcatcgaccgcgtcgcgcaatgccgcgatgtggccggggccgattccgcagcatccgccgacgatccgcgcgcccagcgcaagccactgctccgcccatcttgcatagccgggcggatcgatgtcgccgcgcaaaccgtggagttcctcgttcgcacgcgcatcggcgcgctgaggcggaaacgcgttcgcataggcgccgatcacgagcgacgttcccgttcgcgcaagcccgcgctgcaccgtctcgatcgccgcacccatcgcctccggctggctgcaattgaacagcagcgcggtcgcgcgcgcggacacggcggcgtcgatcgcttcgccgagcgtctgccccgatcgcaataccggcgtggcgtctgcttcgacgtcatcgcgcagcgtgaacgagacccagagcggcttcggattctcacccagcgctcgccggaccgcgccgatctcgtcggtcaggctctgcgtctcggccagccacaggtcgacgtagggatcgagcccatcgacgagcgtcgccaagatggcatcggcgcgcgccgcgtcgaacaggtcggggcggtaggaaccgccagtcggcggaagcgatcctgcgacgcgcacgggccgccctgcgcggtccgccgcttgccgcgcgagttgcccggcaagggccgcgagcgcgactccgtcgcgacggaaccgctcctcgccgatatggaacggcacgaccgcatagctgtttgcggtgatcacgtcggcacccgccgcgacgaatgcgtcgtgcgcaaggccgacgtaatgcggcgcttccatcagcgcgagtgccgaccactccggctgcctgaacggcgcccccatccgcgccagttcgcgccccatgccgccgtcgagtactgtgatgtcatgcatagtccgtgctccgtcgttgcaatccgcgcatctcgtgcccgaatcgattcaaaggtcggcgcgacgcacacgagacgtcgatcgagcgtgcgcaccggtccgtgtcagatctgctccaatgcttgcgcgatatcgcttttcaggtcgtcgatgtgctcgatgccgaccgaatagcggatgaaattgagcggaatgtcggcagcgcgcatttgctccgccgacatcgtgcccgcccacatggatgccgtatggatcgcgagcgaatcgacgccgccgagattgcctgcattcagcggcaagcgcagcgcctcgacaaagcgctgcgcttcgccgtagcctcccgcacgccgaacgccaccacaccgccgaagccgcgcatctgccggcatgcgagtccgtgctgcggatggctgcgcaggcccggataaaacacgcgttcgatcttcgcgtgcgcttcgaggaattcggcgagcgcctgagcgttcgcgttgatccgctcgacgcgcatcggcagcgtgcgcagcccgcgcagcagcagccacgcgtccatcggggacagcaccgagccgagcgtgatgtgcgtatgccagatctgctctgcgagcacgcggctcgtacagatcacgccgccggtcaggtcgtgatgaccgcccagatacttggtcgcgctgtgcacgacgatgtcgacaccgagccggtgcggctgctgattgaccggcgacgcgaacgtgttgtccgcgagcgtcaggatgccgcgcgcccttgcgatttcagtcaccgcggcgatgtcggtcacgagcagcagcggattgaccggcgactcgagcacgatcagccgcgtattcggccggatcgcacgatcgaacgcgaccacgtcggtctggtcgacgaacgtcacctcgacaccgaaccggcgcagcatgtcgtcgagcattttcgtggtgctcatgtaatgacgcgtctgtccgacgacgtgatcgccggccttcacgacactgaggatcgcggtcgcgatcgcgcccattccggatgcggtgacgagcgcggtctcggtgccctcgagctccgccatgaccgcctttacgcgctcgtgaacaggattgccgtagcgggtgtagttgcgcggatgctgcggcacgctcgacatctccgcgaattcctcgctgccggctgccttgaacaccgccgaatagtggatcgccggcgcgaccgacttctcgtcggtcacgtcgcggtccgcagccagcgccagcgtttcaagcttgtatcccatgtcgtcctcggatcgttggttgtgtcgcgttcattcggcgcctgtcaagcacgcgcgctgcccagatggcgattcagcaggccttcgatgcgtttgagcacggtcgaaagcaccgccgtgatgccgacgtacacgatgccggccagcatcagcgcatcggtcgtataggtttcgatcgcgatgcggcgtgcgacaccggtcaggtcgagcacagtgatcgtgctggcaagcgcggtcgacttcagctgcagcacgatctcgttgccgagcgtcggcgcgacgatgccgatcgcgcgcggcacgatcacgaaccaggtgagcatgaagcggctcatcccgaacgcgagcgcggcttccttctcgccggcggggacgccggcgatcccgccccggatgtcttccgccatgtacgccgcgagattgagcgtcagcgcgcacaacgcacacgagaacgatccgccgaccagcagccacagaggcgacgcacgcacgatggagaactgcgcgagcccgtaatacagcacgaaaatctgcaccagcagcggcgtgccgcgaaacaccgacatgaacaggcggctcggtgtcgacagccaccggcacgccgacgtgcgcgcgaccgccagcggcaccgcgagcgcgaacgcaagcgtgcaggacagcaccagcagctcgagcgtgatccatatgccgcgcgcgacgtccgggccggactgcacgatgagggaaagaaagtcgttcatcacgtggcccccgtcaggtgcgttttgcgtaaccgcggcccgcgatgcgctcgagccacgcgaacacggggttggatacggcgagaaagccgaaatagacgatgccgaccgtcatgtagaagacgaatggctgcttggtgaactgcgcggcgatgttggccttgcgcagcatgtcctcgagcccgacgatcgacaccagcgacgtgtccttcagcaggttctgccacatgttgttcaggctcggcaggcagatgcgccacgcctgcggcaggcgcacgtgccacagtgtctgcaggcgtgtcatcccgtacgcgcgcgcggcctcgatctgtccggccggcaccgcgatgaacgcgccgcggaacatctccgacgagtaggcgccgaacaccacggcgagcgcgatcacgccggccgagaacgggctgatgacgatggcgccatcgaattgcgcgttgagcagatgcgacagcccgaagtagcagatcaacaggatcaggaactcgggaatgccgcgcaggaaattggtcagcgcataggtcgcatgtctgagccaccccaggctcgacagctttgccgatgcgccggcgatgccgagcaacatgccgacgcacagcgcggcgaccgcgagctccagcgtgacgagcgcgccagccgcgatctgcgcgccgtagttcaccaagatgtccatcgtaatatcgctccttgtgagcccgattcgcgcaggccgccatacggcgaccgcgcggtcccgatacgcggttattgcggcgcgatgctgaacgggaaatagcgcttgttggctgcggcgaacgtgccatccgcctgcacctgcgcgatgcccttgtcgaacagcgccttcagcggcgcgtcgcccttgcgtaccgcgatcgccgtaccgtcgccgaagatctccgcatcggcgatcggcttgccgacgaagtcgaagccttccttcctgccggccttcgtcagccagtcgtacgcgaccgtgttgtcggcgaacaccgcatcgacgcgcccggcctcgagatcgagccaggcctcgtcgagtgtctgatagaccttcacgttgatccccgacttgctcgccggcaggcggcggcgcagataggattcgtgcgtcgaggccgtctgaacgccgatcgtcttgccacgcagcgtggcggcgttgtccgtgatgcccgagccctgcttcgcgacgagctgcacgggcgccgtcgtgaaaatgcgcgagaagtccaccgactgctcgcgctccggcgtcttcgacatctgcgcgagcaccgcatcgatctgcttcgccttgagcgccggaatcagcgcgtcgaaatccatcgtcacccactggcacttgaccttcatcgtgtcgcacatcttcttgccgacgtcgatctccatgccctgcagcttgccggatgcatccttgtattcgaacggcgcgtaatcggcgagcgtgccgatccgcacgacctgctcggcgtgcgcgaccgagccgagcaatgccgcgcccacgcacagcgactgaagcagcttcttcatggtttcctctccggttgacaacgaatccgcatcagatgatgctggacagaaacttctggaaacgcggcgacttctggctcgcgaacacctcatcgggactgccgtcttcctcgattcttccctgatggacgaacacgacccggttcgcgacttcgcgtgcaaaccccatctcgtgcgtgacgacgagcatcgtgcgtccctcgtcggccagcgagcgcatcactttcaacacttcaccgacgagctcgggatcgagcgccgacgtcggctcgtcgaacagcatcacgtcggggtcggtcgcgagtgcacgtgcaatcgcgacgcgctgctgctggccgcccgacagctggttcggatagtgttcgcacttgccggcgagcccgacccgttcgagcatcgcaatcgccttgtcgcgggcgtcgcgcttcggcacgccgagcacgcgcaccggcacgaacatcacgttctgcagcacggtcatgtgcgcccagagattgaactgctggaacaccatcgcgagcttgcggcgcacgcgcatcacctgctgcgcatcggccgcgacgagcgcgccgtcgcgtcccgccggcttcagcgcgagcgtttcgccgttcacgcagatccggccgcggtcgggcatttccagcaggttgatgcatctgaggaacgtactcttgcctgacccgctgctgccgaggatcgacacgacctcgtgattcctcgcggtcagcgagatgcccttcagcacctcgacaccgccgaacgacttgtgaatatcctcgaccaccagcgcgtccgccgccggtttgcatgcaggaattgctgctggcatcctcgactccttcttcgatacgttgctcaccacaccgctccggttcgcgccgcgccggcccgccaggcgccggcgcggcgcatcagctcgacagccgccggttgcgcctgaagcagaccaccttcggctgcgtcatttccgtcatcgcaaaccgaacgccttcgcggcccagcgacccatgcttgaatccgccgaacggcatgccgtcgaagcggtagtcggaagaatcgttgatcatcacgccgcccgcctgcagttgctcggccgcgccgagcgccacctccagccggctggtgaacacgcctgcatgcaggcagctctccgacgcgttggccgcatcgagcgcctgctggaggtcggtgaatttctcgatcgtcacgaccggcgcgaacacctcgtcggtccatacacgcgcgtcgtgcggcacatccgcgagcaccgtcggttcatacagcgccccgcgtcggcgatgaccgctcagcaccgtcgcaccgcacgagaccgcttcgtcgacccagcgttcgacgcggatcgcctgttcctcgccgatcatcggccccatgtcggtcgcatcgtccagtgggtcgccgacgaccatcctgccggtcagctcgacgaaataccggacgaacggctcgtatgcggcctcggcgacgaagatccgctgtgtgccgatgcagttctgtcccgccgcccagaacgcgcccgacacgcaggattcggcggcatccttcaggtcgcagtcggccatgacgatcaccggcgcatttccgcccaggtccatcgcgatcttcttgagtcccgcatcgcgcgtgatggcttcgccggtctgcgggccgccggtaaaggtcaccatccggatccgccggtcgcgcaccagggccgacgcgatatccgcgccgccgtgcacgatctgcaacgcgtcgcgcggcgccccggcttcccacagaacctcgacgagggcctgcgccgacagcggcgcgagcaacgagggcttcaggatgaccgcattgccggtcgcgagcgccggcccgagcttgtgtgcaacgaggttcagcgggtcgttgaagggcgtgatcgcgagaatcacgcccagcggctccagcgtgtagtagccgctgcgatcctcggagccgggatacccgtcgaacgggatcgtctcgccggccagtcgcttcgcttcctcgcccgacaggcgcagcgtgttcacgcagcgcgcgacttccttgcgggcctgccgcagcggcttgcccgcttcgagcgcgatcgtgcgtgcgaatgtctccgcttgtgcttccacgctcgcggccgcgcgaaacaggatgtcggcccgccggctgcgtggcagggttgcggccgcgcgcgcgcgtcgagcgcgcgctcgacgaggaccggcgccgcatctgcaggcgacaggcgaacctggccgacgatcgagccgtcatagggcgaccgaacatcggccacgccggctcccgtgcagtcggtcatcaccgcatcgcgcgcgctcatgccgccacctcgtgcgaggttgcgccgattctgtccgcgagttcgatcaggtcggagagaatcgcgaacgccgtttcctcacggccggcacccggcccgctgatcgtcacgccgccgagtacgtcggtgtcgaacgtgattgcattcgtcacgccgctcgcggcaagcagcggatggccgaccgggagcttgcgcggttcgacgctcgcggtcacggtgccgtccggatgacggacggcagaaccgatcaaccgccacgacatgcgctccgccgccgccgcgcgcacgtcgtgctcggtcaattccacgatgccgcggcacgtcacgtcgccacgcttgaggccggcattccacagcgcgttcgccagaatgacgactttcagctgtacgtccgaaccgttgacgtcggccgccggattcgcctccgcatagccgcgctgctgcgcatcccggatcgccgcatcgaagctcgcgccggcctcgacctcaccgaggacgtaattcgacgtgccgttcaggatgccggcgaagccgttgatgtcgcagccgcgcagcgaggtcgcgagctgccgcagcaccggcgtgccgctcatcaccgtgccttcgtacatcacacaggcacccgattgcgcggcgatccgcgccagtgccggctgcgcgagcgcgatcggccccttgttggtcgtgatcacgtgcttgccgcattcgagcgcggtacggcaatgcgacagcgcaggctcgccggtgttcggatcagtgaaggtcgcctcgacgacgacatccacgtggtccgatgcgatggccttcagcaccgcaccgaggccgacgtccggcgacaccagcgtgcccggatcgcggcgcaacgcttccgcatcgacgccccgccgcgcggtttcgtcgaggacgtccagcgcgataccgcgaggattcgtcgcaatcccgagccgcaggtcggcgaccatcgtcaccgatacgtcgagtcccgccgcccccagcattgcacgcttctttttgagcagttcgaccagtccctgattgactccgccgaaaccgaccagtgccagtttgagttccatctcgatcatctcctgttcattgaccacgtgatacaggttagtcgtgcgaatcgattttcaaattagtcgtttcgcccgaatcaggtagtcatccgttgcggtttgtcatgcggaacgggcggatcgcccgttgccgcgcgaagcaattgcgtcaggtggccggcggttcgtcatccttgtcgaccggcacgaacagcccgaccttgaccgcgctcagcacgacattcgtgttgatccggcggatcatcgggttgctctgcatgatccgcgcggacagccggtcgtacgcctcgacatcgcgtgcggtgatgatcgcgatcaggtcgacggagccggtcacgtagtagatctgctggatttcgtcgtgcgccttcgaccactcgcggaacctggcgaccgtctcgtagttttcgcgttcgatctcgattgccgcaatgaacgtcatcggcctgccgaccgccgcgcgatcgaccaccgcgatttccgccgaaatgatcttttcggtgcgcatgcgtttcagccgcttctgcacggccgaggtggacagaccgatccgttcggcaatggcgtccgccgtcgcggtgcaatcgcgctggacgatattcaggatcttgcggtcgaaggagtcgagtgcgtcggtcatggcgtggcctgccggagaacggatacttgcgtcaaagataaaaaggacgggccgatctgagcccgaccagatgccggacacggtcgaacgcggtaacgagcgattcgcgccactgcgcggctggcccgcggatgcatacgggttcgaaatggatcgtgtccacacctgcaggaatacggaacgggcgctcgatgccatcgtccgattcggtcacgagtgcggtgccgtcgacttctgtcaggctcatcagcagatgggcgggcgcagtggcgccaagcaggttgcgcagaggcgactcgtccgcggacaactgctcgagcagcggcagctcgtacgcgccgggccaccaggtatcgtgctcgtcaagccacgggccgacgcccggcatgccgaccatctcgaggatccggttcgcaccgagatgcgcataggctcgacaccggcccgccccgtcggtcgaagcgcgtgccagccagccgccggcgctcgggacaggatccgtcaacgcgacgttcgcaggcttcagtcggccgagcatttcagccgcgcttgcagcggatcggtgcccttcgcaggatctctgtgcgtgatccgtgacgatacgacacacccacttgggaccatcctgcaaggcggcggggacgtcgccggaccggacttgggcggttcgcctgcgggcgtgttcgacgatgacgattggcgtgtccggcatacaactctctcgtgcttgcggggccgcgtcgcagcaatgctggcgcgcgtcatggattggccgacgatgttggggctggagaaatcatatcgcctcggtgcgactgaaaaatctcaaccgcgtcaaacatcgacgcaaaacgtcgaaaagcacggctttcttgacgttttacatcccaccaaacaccggccagcctggcatccgtcgcgaacgccaaaccagcaggtcaatccgatgcaccgaacaatcgaatcacgacaccacgcagccatcgattgcccgcctcatggtgatatcgcgcatgccaatgctgccgtaccgcaaacccgtcgaccgggatcgggcatgcatgaaccgccagatcgctcgcctgagccagtgtctggccgatatgacgaggtagcgtcgtaatcaggtcggtcgtctggacgatcgccccaggcccagaaaccccggcagttccagcacgacgtcgcgctcgatgcgcgcctgccgcagcgcctgttcgaggagttgcgcgcccgttcccgccgtaatggcgacatgtccttcggaacgatactgcttcgccccgagacgaccgcgaatcctcgggtgatgccggttcgccaggcatacccagtcctggtcgtacagcttctgctgataaatgccgccgcccagccacggcacatagccgatcgcgaggtcggcttcgccggattcgagcgcgcgctccgtattgccgtcgatccgtgcggcttccagccggacgccgggcgcctgcgcccggacatgggccagcagccgcggaagcagcgtgatgtggctcgcgtcggtcatgcagatgcgaaaccgtcgctgggccgtcgcgggatcgaacgcgatctcccacgcagtgaagcgccgcagggattcgagaatttcccggcatggcccgatcagcgcgtcggcttgcggtgtcggcgccatgccgccgggcgtccggatgaaaagcggatcgtgcaggtgttcccgcaagtgcccgagccagatgctgaccgtcggctggctctggcccagttgctcggctacgcgcgtgacgctgcgcacgtcgtaaagaagatcgaaaagctgaagcagcttcaggtcgggcaggtcggcgggcatcgcggcgttattgtccatggcaatgacgccattgtatccattgcattggcggcatgagcggcgacgcctatcgtgatgccatacgtcagctttgcatgggaccagagtaaggcgccaaagcgccaactctcgtcgacaaaggagaaaccattgaaaatagcaattctgggcgccggcgcactgggctgcgcgatcggcgccaccctcacccaaggcggccatgagacctggctgatcgaccgctcgcccgcacacgtcgatgcgatgagccgtgacggcctgcgcgtcgacgacgccggcggcacccgccacgtacgcgtccacgcgacgacccgggctgccgatgtcggcgtggccgacctggtggtggtgctggtcaagtcgttccacaccgatgcggccatccgcggcgcccaatcgctggtggggccggataccgccgtgctgtcgctgcagaacggcctcggacacgaggacatcctgatcgacgtcgtcggccgcgagcgcgtcctcgcgggcaagacctacgtcggcggcgtgctgcgcggcgcgggtcatatcgaatccggcgtgatcggcaaatacacctacatcggcgaactcgacggccgcatcacaccgcgtgtcgaggcgatcgccgcggcgttcaatgccgccggcctcgccacgacgatcagcgacaacatcgtcggcacgatgtgggacaagctgctggtgaacgtcgcgacgggcgcgctgacgggcctgaccggcctcacctacgggcagctttacgacgagccgctgctgaaggcgacgtcgctcgcggccgtggccgaggcgatcgcggcggcgcaggctgcaggcgtgaagctgtcgatgaccgaccccgaacaggcatggacgctggccgccgagggctgcccgcgaccttcaagacgtcgatgctgcaaagcctggagaagggctcgatcaccgagatcgacttcatcaacggctcggtcgtgcgctggggccagcgctacggcgtgccgacgccggtgaatgcaacgctcgtcgcctgcatcaaggggctggaacgcgcgatggccgaccgccaacggcaggaggcggccgcatgaatgccacgaaagcctatctcgaacacgttgcgatctgggtgaaggacatccgctggcacatccgtttcttcgaggacgtgctcggcatgaccctgcgcgaagtggacggcacgctcgacgcgccgcggcagtactggacgctcggcggcctgcagttcatccacgcgccggaatacgaaggcccggaaggccggctcgcccatctcggcgtgatgtgcgaagacctggaggccgcgctggccgcggcccaacgattcggcgtgacggagatgccgcaggggcgcaactggcttcgcctgcccgacgggctcgccgtcgaactgatccaggcccggccggcttcctgcgtcgcacaggcgctggcaatcaacccgcgcgcggaggcgtgaccatgacgatcgtcgaaaatactgggacgacgcccgcgagggtgacacgtgcacgagcccgaactacatcgtgaccaaggagcgcattctcgcgtacgccgacctcaccggcgaccatacgcccgtccacgtggacgaggaatacgcgaacgcgagccatttcggctgcctcgtcgcgcacgggctgttcggcctgtccatcgccgacggcctgaagacgcagagcgactatcgctttctgccgggcatgtcgctcggctggacctgggatttcctgctgccgatcaaggtcggcgacgtgctgcacgtgaagttccgcgtcggctcgatgcgggccagcaagagccgcccggactggggcatcgtcgtgctgccgtccgagctgatcaatcaggacggtcaggtcgttcaacgcggcgagcatcgcctgatggtgccgcgccgcccggaggcactgtaatgcaggctcgcccactcgaaggcattcgcgtcgtcgactacagccactttcttgccgggccgtatgtcgggcgctgtctcgcggcgctcggcgccgaagtcatcaaggtcgaacggcccgggtccggtgacgccggacggcagcacgcgaccgtgctcgacgaccagcaaagcggctacttcctgcagctcaacatgggcaagcgcggcgtgagcgtcaacatgaaggacgcgcgcggcaaggcgttcatgcagcggctgtgcgactcggccgacgtgttcatcgagaactatcggccgggcgcgctggacaagctcgggctcggttatgccgaactgtcggcgcgcaatccgggcctcgtctactgctcgatttcggcgtacgggcataccggccccgacgcacatcgcgcgggcttcgggctgatcgcggaagccaagagcggaatcatgcagatggtcggcacgccgggcgagcggccgccgctgctgcgcatctcgctcggcgacatgtacaccggcatccatgcggtcgcggccatcaatgccgcgctgctggggcgcgtgaagagcggccgcgggcaacacgtcgacatggcgctgtacgacacgctggtatcgatgcacgaatatgcggtgcagtgctacacgctgcagggcgtgctgcccgagcagaccgggcacgacatgccgacctcgacgctctacggcgtgtttcgcgccgcggacggcgatctcgtgatcgccgcgcaagtcgacgacgcgtggaagcgcttcgccgagctgatcgcgacgcacggcggcccggcgggcttcggcgccgacacgcggtttcacgacagcaccgggcgcaacgcgcaccgcgcggagattctgtcggtggtcgagccgtgggtggccgcgcgttccgtcgcgtcggtactggatctgctggacggcatcgatgttccgtgcgcgaaggtgcagcgcatcgacgaggtgttgaacgatccgcagatccaggccagaggcatggtcgtcgagcaacagcatccgcgctacgggacgctgcgcctgcccaacctgccgttccggttttccgattgcgacacgacgattcgcgacgtcgcgcccgatctcgggcagcacaacgcggagatcgcgcgttccctcgggttcgatccggccgaaatcgacgcgatgcaggccgacggcgtcctctactcaaaagcgagccaatgatgaccgaccaatacgcggtgatcggcaatccgatcggacacacgaaatccccgttgattcacggcctcttcgcgcaggagacgcggcaggacctcagctatacggcgatcgaggggccgatcgaaccggcaggcgccttcgctgacgcggttcgcgcgtttttcgacggcggcggcaagggcatcaacgtcaccgcgccgttcaagctcgacgcgttcgcgatgtcggacgaacgcagcgagcgcgcgcagctcgcgggcgcggccaacgcgctcaagttcgacggcggccgcatcctggcggacaacttcgacggcatcgggctggtgcgcgatatcgaaacgaacctcaatctgccgatggccggcaagcgtgtcctggtgctcggtgccggcggcgcggcacgcggcgcgctgctgccgttcctcgaagccggcccggcggaactcgtcatcgcgaatcgcgacgtcgacaaggcacgcgcactggccgcgcaggttgccggacgcggcccgctcgttgccagcggctacgcggacctcgcgcgcatggggcgtttcgacctcgtcgtcaatgccacgtcggcgagcctgaccggcgacctgccgccggttccgccgagcgtgttcagtccggccggcacggcctacgaactggcatacggcaagcgtctgacgccgtttctccggctcgcgaaaaacgcaggcgtacacggaatcgcggatggcgtcggcatgctggtcgagcaggcggccgaagcgttcgcgtggtggcgcggcgtacgcccccaaaccagcgcggtgatcgatcgcctggccgtgccctttgattgaacacgcaacggagattcgcatgaagaagatcctgatgctgcacggcatcaatcacaacatgttcggcaagcgcgatccggcgcagtacgggacgatcacgctcgcgcagatcgatgcgcggctgcaagggctggcgacggaactgggtgtgcaggtggaatcgttccagacgaaccacgaaggcgcgatgtgcgagcgcattcatcgcgctttcgaggaacgccaggacgcggtgctgatcaacgcgggcgcatggacgcattacagctacggcattcgcgatgcccttgcgatcctcacgtgcccgatcgtcgaactgcacatgtccaacattcatgcacgcgaaccgttccggcatcactccgtcctggccgagatcgtcagcgggcagatttgcggtttcggtgtccaaagttatctgctggcgctgagggccgcggtttcggcgctcggcgacgaataagccgagtcccgcatcggctgccgatgcgggaccgacgcgcatgcgcagccgtcgccagggcgcggcgttgcgcaccgcgcgtgctcgccgcgcgccgtatcgacgggccgcggtcaggtcgcacgacggggtcgacacatcgggcagtgacgactcctcgcatcacccgccttgcccggcacacatatcaatatccggagacgacgatgaccacgaccttgcgagacgagcccaggggcaggcaccaatcgagaaaagccgccatcagcggctggatcggatcggtgctcgaatactacgatttcttcatctacgccacggcatcggcactgatcttcccgcagatattctttccgcacgggagccccacgacggccatcatcgcgtcgctggccacttacggcgtcggctacgtgtcccgcccgatcggcgcgttcgtgctgggccacctcggcgacacgcgcggacgaaaaaccgtcctgctgttctgcatgttcctgatgggcatctcgaccgtcggcgtcggcctcctgccgacctatcagcaagccgggctgatcgcgcccgccttgctggtgacgctgcgcctgctgcagggtttcgccgtggccggcgagatcaccggcgcgagctcgatgatcctggaacacgcgccgttcggccggcgcggctacttcgtcagcttcacgctgcagggcgtgcaggccgggcaagtgctggccgccgccgtgttcctgccgctcgcctactacatgccgtccgcgcaattcgatagctggggctggcgcatcccgttcctgctgagtgcgctggtcatcgtcgcgggcctgatcattcgccgcgaggtcgacgagtcgccggccttcgacgaagcggtacgcaaccggtcgcaagccggctcgccggtggccgacgctttcaggcaccactttcccgacatgctgcgcgtggcctgcatgtcgatgatgaacgtgattccggtcgtcgccacgatcttcggcgcggcctatgcggttcagcctgcatatggaatcggattccagaaggatgtctatctctggatcacggtgatgggcaatatcgttgcgatgatcgtgattccgttcgtcggcaacctgtccgaccgcgtcggccgccggccgccgatcatcgtcggctcgctggccgccgggctgctcgcgttcgcgtacctgtatgcgatcagcatcaggaacgtgccgctcgcattcgtgatgtcgatgctgatgtggggcgtggtgtaccagggctacaacgcggtattccccgccttctacccggagctcttcccgacccgcacgcgcgtctcggcgatggccatcgcgcagaacctcggtaccgcggccacggcgatgctgcccgcgctgttcaccgcggtcgcgccgcccggcgcccatcacgtctggctgatcgtcggtgcgatcgcgttcggcatcaccgtgatcgcgtcgctcgcggcctggagcgcacgcgagaccagtcgtgtccatttgaacgacctggggcgagcgaacgcgcaaccggtcgccaaggcagaatacgacctgctgcgcgccgaggcgctgtcgcacgatcgcgtcgtgcacgaacccgtgcccggatccgtcggcagctagccggcgttcggcggggcgtcgggttcggcgccccttccgcccggccatgtcagctcgccgcggccgccctcgccggacgagcaaccttgcgtaaccgcagcccttactcgaagctcgatgcccgataccgtgtcgaaaaccgccatgtcggactccacgcgacccgctcgcctgaacttcgcgctcatgttgccgcttctgctggcggcccagccggtggcgaccgacagttacctgccggcgctgcccgaaatcgccgccacgctgggctccgccagtgtcagcctcacggttttcgcgctgatattcggtgtcgggcaattgccgatgggcagcctttccgaccggttcggccgccgccccgtcctgctgaccggccttgcgctctatgcgctgtccgcactggccgctgcgctggcctcaaccgcggcgatgctggtggccgctcgcgcgatgcaggggctggccatggccgcgatactggtatgcgcccgtgcgacggtgcgcgaccggtattcggcgggcgacggcccgtacgtgatggcgcgcggtttcatggggatggggatgatggcgttcctcgccccgatcctcggtgcgtatgtcgcacagcaggccggatggcgatgggtgctcgccgggatgagcgtgtatgcgctcgggttgctcgtcatgtgctggtacggcttcgaggaaagcttcgcgcgaagcgcgccgagccaggactcgaaccgggaggtgcgcgagatactcggcaatgccccgttcagggtctggacactgctggccgcgtcgacgtacaccggcatgttctgctttctgctgctgtctccggctatctacatcgggcagctcggcatctcgccccagcgttatggctggataccggcgggcggtacgctcgtctatgtcctgagcacgtttggttgccgcgtgctgctgcgccgtcaaagcatgttgcgaacggtacgacaaggcgcaacgctgagcctctgcggcgcggtgatccaggcattgggctgcgcgctgcttcccggcagcatctggccgctgctcgtcgggcatggcgtgtattgcctcggccacggaatccatcagccgtgcgggcaggcaggggcagtcagcggcctgcctcaccttgcaggccgcgccgtatcctggtccggcttcatcatgatgttcttcgcgttcagcgtaggacagacggcagcgggattcgccgatccgcgttaccagtcgggcgcgtggccgatggttgtgccgatgctcgtcgttggcgtgacactggtgacgattgcgtatgcgtggctgccaaagtcatccacgcgaccttggtcgccaggtaatctcctcgatttccacgatccggcgatctgtcgcagcgcaaggatcacacgcgtcaaagagaccgggctctcaccggcccgttacgtgccggctgcgcgggtcgggcgtgcgaaggcacggctggagcgggccgactggccgctcgaacggatagccgaacgatcgggatccacaagcgtggacgtgttacagcgtgcgtttgcaaaatgcgtcggcgcatcgccgcaggactatcgtgcgcggttcgggcaaccacggcgggcaaacccgaagacatcggtttcaggcaacgcaacacgcatggcgccggcagaatcatgcacaatgcaccgcatctgagtggcggagacttgcctgtggggatcaacttcgatttaaccgacttgcaggcatttcgcgccgtagtggaaacggggagcttccgaaaggccgccgacgcagtcaacctctcccagccggccttgagccgtcgtatcgacaagctcgaggaggcgctcggcgtacgactgttcgagcgcaccacgcgcagcgtctcgctcaccacggtcggtcgcgtgttcgcgcagagtgccgaacaactgctcgacgatctcgatgccgccctgctcggcattcgcgacgtttcatcgagccgcctgggccatgtgacgatcgcatgcgtgccgtcggtcgcctactactttcttcccgccatcgtcgcgcgctatcatcagcgctttccgcgcatcagggtgaagctgctcgatgcaagcgccaacgaggtgctcggggccgtcatcagcggcgaggcggatttcggcgtgagcttcatcggcagccaggaggctgagatcgagttcaaggtgttgctccaggaacgcttcgttgccgcctgtcgccgcgaccacccgctcgcacgcaagaagcgcgtgacctggaacgagctttacgagcacgactatgtgtcggtcgacaagacttccggcaaccgtctgctgctcgaccaggcgctgaccgccgtcgcgccgcgcgcgccgagcgtctgcgagacacgccacgtgacgaccctgctcggattgatcgaagcggggctcggcgtcgccgcggtcccctcgatggcgatgcctgggcatgaccacccgattctcacgagcgtgccgctcgtcgaaccggtcgtcaaacgacgcgtgggaatcgtgaagcggcgcggacgaccgctcacaccggccgccgaggcgtttcatcggatggtcatcgaggcgaagcgtggcgggaccgcaagcagtggcgcatcggcgtaacgacgacagagagacacgaaggaagaccggacagtgaggttggccaggccgcttggatcgctttacgtgcaggttctgctcgcgatgatgctcggcatgggcatcggtcacgcatggcccgcggcgggcgcgatgctcaagcccctcagcgatgcgttcgtcggcctggtcaagatgaccatcgccccgatcgtcttttgcacgatcgtctcgggcatcacgtcgctggcgaacgggaaggcgatcggccgcacgatcgtgcgggcactggcgctcttctatctattgaccgccgctgcgctcgcgctcggactcgtcaccgcatatgtgctgcagcccggcgccggcatgcacgtcgacgtcagccacctggatgcaggcatcctcgctccgtatgcgaagcatgcggagccgcggggccttgtggagttcgggctgagcgtgattccggacacgatgctcggcgcgttcgccaaaggcgaagtgttgccggtgctgttgctgtcgctgttgttcggcttctcgctgaatgcgcacccgcgggccggccggcccgttcttgcgctgatcgacggtgtcgcccaggttgtctttcgcgtgctcgcgatgatcatgcggctcgcgccgctcggcgcattcggcgcgatggcgttcacggtgggccgtttcggcatcggttcggtcggctcgctcgcgaagctgatggcgtccttctacgtggcctgcgtgctgttcgtcgcgctggtgctcgcaccgctcgcgcgactgcacggtttcgcgctgtggcggctcttgcgctacatgcgcgaagaattgctcatcgtcctcgcgacgtcgtccacggagcccgttctgccgcgtctgatcgtcaagctggaagcactcggctgcgacaagggcatcgtggggctcgtgctgccggcgggctattccttcaatctggacggtaccgcgatctatctgacgctcgcggcattgttcatcgcccaggcgtgcgacgtgccgctctccgcgtcgcagatcgcggtgatgctcgccatcatgctgctcacgtcaaaggggcggccggtgtttccggtagcgggctggtggcgctggtcgccacactcgccgtcatgcccgacctgcccgtcgccggcgtcgcactgctggtcggcatcgatcgcttcatgtcggaggcgcgcgccctgacaagcgtgatcagcaatgcctgcgcggtgatcttcgtttcgctgtgggaaggtgcgtgcgatcgcatacggcttgcgcagaggctcgccatggccggcccggcatccccgaacggggccgatgaaggcagtaccgcaggggatgccggcggcaacgggaagactttgtgacacaagccttcccgcgggtcggactcaatgcgcggggacggcatccagtccggttgttttcacgtcagcctgcacgtcgggcgacgccagataatcgagcagcgccttcgcttccttcggatgctgcgcgccgacggggatgccggcagcgaaacgcgtgacggactgcagcgattcgggaatcttgccgacgaaggtcgcaccgtggacgggcagcagctcgctgacctgctggaagccgatttcgtagtcgccgttcgcgacgacagaagccaccggaatccgcggaatcatcttcgccttggacttcacctgctcctcgatgccgagtttcttgaacaactcgcgttcgatatacacgccgctcgcgctgtccgagtaggcgatcgacttcgcgtgcagcagcacctgcttgagaccttcggtggtgctgatgtcgggttttgccgcgccgtcgcgcacgaccatgccgatgcgcgaatcggcgagctcgactcgggatcccgggatgaccttgccttgcttgatcagttcgtccagcgcgtagccgaccatgatgacggcgtcggcgggctcgccgcgcgcgagccggttcggaatcgcttcgggcgacttgcccatcgacgggccgagcgcggtgtcgagcgtattgccggtcgtggacgcgaaccgcgggccgagcagtttataggcggcggtgaagcccccgagctcatcacgtggagctcggccgcctgcacgttggccgcaaacgccgcgctggcgacgagcgcggtcgcgcaaaatttcaggagctgatttctcatggtcgtggtcatgcgaattcgtgtgtgtgggtgaagtttcggatgggctatcaatgcgccggcgtgagcgtcgccgtgcggtgacggtagagcgcgaacgtcgcaagcagcgcgcacaccgcggcgaagctcatccagtagccgggtgcggccttgtcgcccgtcatgtgaatgagcccggtcgagatggccggcgtgaagccgccgaacacggccgtcgcgaggctgtaggcgagcgagaagcccgcgacacgcacctgcaccggcatcacttcggtgagcgcaacgaccatcgcaccgttatagatcccgtacatgaacgagagccagagcaggacgagcagcatgttggcgaacgacggcgcgtgagcgaggaacgacagcgccggataggcggtcaggacggtgagcatcgtcatgccgaccagcagcggccgacggccgaaccgatcggacagcgcgccgccgatcggcagccacacgaagttcgacacgccgacgcagagcgtcacgagcaggctgtcggcggtgctcagatgcagcaccgtcttgccgaaggtcggcgcgtagacggtgatcagatagaagctcgtggtggtcatcgcgacgagcatcatgccggcgaccacgacgccccagttctgaaccagcgtgccgaacacttccttcatgcccgggcgatgcttgcgcgccttgaactcctgggtttcctccaggttgcggcgcagcatgaagatgaacggcacgatcatgcagccgacgaagaacggcacgcgccatccccaggtggcgatctgcgatgcgctcagccactgattgagcgcaaagccgaggcccgccgcgatgacgatcgcaacctgctggctggccgattgccagctggtgaagaagcccttgcggccgggcgttgccagctcggcgagatagaccgatacaccgcccagctcggcgcctgcggagaagccctgcagcagccgcccgatcagtacgagcaccggcgccagcagcccgatcgacgcgtagcccggcacgaacgcaatcaggatggtgccgctcgccatgatggacagcgtgacgatcaggcccttgcggcggcctacctcgtcgatgtacgcgcccagcacgattgcgcccagcggccgcatcaggaagccggcgccgaacacggcgaaggtcatcatcaacgaagcgaactcgctttgcgcagggaagaagacattggcgatctgcgtggcgtagaagccgaacaggaagaagtcgaactgctcgagaaaattgccggccgtgacgcgaaagatcgcggcggccttcgaacgttcggccggaaggctggacgaggggtgcatcgaggtgtctcctgaaaatccggaaatatgcggggcgggtcgattgtggttttccggaatgttcgctcgacgtcgatcaaacgataagtgcgatttttggaagaattgatgcaaggaggttatcaatcgacacggcctcgcctgtttcgatcagcgcctgcacggcgtgcgacgtcggtgggcatcacgagatgtcgagctgatcaagcgaaacactcggcgactgctcgccaggatcgcccacgatcgccggcgcagcatgctgcctgacgaggtgtccgagaaggacccgatggagttcgacggagaaacccgggcgaccatcaagcaggcgatcgtccgcctggcggatctgcttttcggcgacgccggttaccgtgcgacaggcgccagcggaccagctcgtccgcgccgggaccttcctggatctccaaatccgccgcgttggtctgctccccgtctcctgatcgataaagctccaccgcacctcggctcccgtctttcgattcacgaacttcatcggaggcgccgaagctccggaaacttccagactgtccccaatctgggcgagtaccggcatcaccggggcgatctgccagcccttgtgagtcaggagatattcaaatcgctccggattcacctgatagcgcctacgctcaacgaggccgttggcctccagatgcttgagccggtcgctgagcgtcgcgttggttatgccggacgactggcgaaactcgtcgtaccggctaagcccgcagacaaggtcgcgaagtatcagcaagccccatcggtcaccgatcgccgccatgacgccggcaatcgggcacaccattccgtcaaaacccttcgagcgcatgagccgtttcccagattagccccggcgatcgtcgccgagggtgagtctcattataagagtcgcacgagcatcgactggacgtttccacccaagagcccttcgccttcccggttcaagtgccgaaaagtccttgtcttgcgggacactcactcttattataagagtgagtgtcccttgttgaccggcgtcgccggtaggcgtccgtagcatcgaactcaaggaaaccatcatgccttcccatgccacttccagaatcttcgtcatcggtggtacaggcgcgcagggcctgcctgtcatcagcgcgctcgtcgcggacggcaagtattccgttcgcgcgttgagccgagatcccgattcccggcgcgccaaggcgctgctcgcactcggcaacgtgtcgatcctgaaaggcacgtttgccgacgaagccgttctgcgggcaggctttcgcggctgcgacggtgcgtacgtcaatctggacgggttcaacaccggcgagaaaacggagatctactgggcgatgcgttgctacgaaatcgcgctggaagaaggcatcaagttcttcgtgtatggcaacctcgactacgcgctcaaacaggccggctacgattcgcgctttcgtgctggccactacgacggcaaaggccgcgtaggcgaatggatcctgttccagaaccagacgagccgggagcgcatgggcgcggccgtgttcaccaccgggccatacatggagatggccatttcggcgatgacgccgatgatgcccttcgtcgaggacggagtcgtcacctggcgcgtgccgctcggcaacggtgcggtgccgcatgtcgcactggaggactgcggctactacgcgcgctggctgttcgatcacccggagcgcgcgaacggcatggatctccaggtcgccattgagcatgtcgcgtacgggaagctggccgaggcgttcgaacgggtaacggggcatcctgcgcgctacatcgacacggatctggacacttactggaacggcccgctcaagatggcggcgagctcgcccgccggatacaacgcggacccgaatgacaagagcacgatgagtttccgcgacaacttcactggattctggaacatctggaagcacggcgtcatccgccgcgactacgcgctactcgacgaaatccatccgaaccgcatccggaccgtcgagcaatggcttcgacgagaagacgagcgtggccagcagcaaggcaaaggaagtctctgggagcgggtgcagccggaaaccctgttcaagtcggtgccgcttctgaagctgtccgaagacggcagaaaaggcgcgctttaatctacggcatcacgtccagtagataccgggaattcgatcaatatttagttaacctaatgggcttcggaaatgaatcagatcgtcgaaatccggaagaacggcgggacgggcttgctgggtgtgctgatcgtctggggttagccgttgccgcggcggccgaagcgggggtttatcgagcggtctacccgctggggctcgcctgcctcattgccctcggtatcgtggcgccagttgtcgtttattcgatgtcccgcagctttcgcacatacatcgcgaccatcgggctaagaacgctgacggcgtttcatatctggcggattgcggccgcgctggtcttcttctggtacggggcgcacgatctcctgccggaagcattcgtcaggaacgccggctgggggacctcatcgcggggttgatggcgttcggcgtcaccatgctgccgaaaacgcgcaaccggtatctgatctttcatctgttcgggttcgcagatttcgtcgtggcggtcggtacgggattgacctacttcctgctcaacgatccccgcatgtccggcatccagacactgccgatggcattgatcccgttctacggcgtcggaatttcaggagcgagccacatcatggcgttcgacctgctgcgccgccgcccgagcccctcgaacgtgcggtgaggcttgccgaagcaacggcactagcgcgccctgtacgaaaccgcttcttcaatcggacaaggaaatcatcgtgaactttcgtcgtacccgtgccgcagccagcgtgctgttcggcttgctgctgtgcggccccacgtttcaggacaccgcctcggcgcagcccggtatcccgtcggccgcctccgccggcgaagcgacggcgccgtgggaccagcgcgcgaatccgacggccgttgaggccgatgcctggttcgacaactaccggttccgggatggcgagacgctgccccggctgaggatccactatgcaacgctcggcacgccgcatcgcaatgcccatggcgccgttgacaacgccgtcctggtcctgcactggaccggcgcggacagtcgaacgctgctgagtccgacttacacaaaagccctgttcgaccgcggacgtccgctcgacgcgaatcgctactacctgatttttcccgacaacgttggccacggccagtcgagcaaaccgagtgacggtttaagggcgaaatttccaaactacgattacggcgacatcgtcgatctccagcacaagctggtgaccgaaaccttgggcatcgagcatcttcatgcgattctcggcatgtcgatgggcggcatgaacgcctggcaatgggcggaaacatatcccgacatgatggacggcgtcatgcccgtggtctcgctaccgattacggtctcgggccgcaatctgctgtggcggcgcatggtgatcgacgcgatccgctccgatcccgactggaagagcgggagtacacgcaaacgccccgcggctgggtccaaggcttcggggtgttgcgaatgatgatcgacagtgcgcccgcgctacagcaggaaattccggacggcgcggcggcaagcaagtttctcgcgaccgtgcgcttccaggcggagcatgtcgacgcgaacgacattctttattcgctcaagtcatcgtttgactacgatcccgagccagggctttccaggattcgggccaagctgtttgccctgaatttctccgacgacgaattcaaccctgacaccctgcgcgttctcgagcgacttgtgccgacacttcagcatggccggtatctggtgcagcagggcacaccgtcatcgccgggccatttcacgatgactcgtcccgatctttgggcgcggcatgtgggcgaattcatgcaatggctgggcgatgcaccctcgcaagcgagtcttggcgatatctggccgattccggtttcagccggctcatgatgtgttctacgaggaatgggtccgcggcgaccgcttctgaatctcgatgaggcaattgagcggtctattgaaggatcggccagtggcagccactggccgagactgtgtagaaacgcgttcgatcacctgggctggatcaatccgttccgatgagaggcgacgatggggcgttttgtcgacggcgaggaccgcaagcaagtaacgttgcgtcccgaatgtcttgatgacttcatcgccgaggacagagcaccccgctacaccgcttgcatgaattgagcagatctcccgactgggccagcgagcgctggatcggttcgttggccggggtatcgagggacggcaccttttcgggctcagcagcgaccgaactcataagcccgacgatcaggtcgggcggttcgatcgcatatccgctgggcgcgagtaccccgttcacgtggtgccagggcggcagccccatatccggatgcagtcgatcgataccgcatatgccgtcatgcaggcactcgacaaagagtgcggcgttatcggcgaaccgtcactgaaattcaagagcgttgaattttcgctacccagaaaacaccacaagtttcgagccgcggcggttgctccaacaagcgtggtcaccttttcgccagtcaccgccatccatccccaataaatccccttgacggcctatctttcgatatatatctttagatatgttttccgacatataggacacgatcatgcgacacaacccttcccgcggccatgcccgaagcgacggtcatggtgcgcatgcccgccctgactggttcaccggtctctggtacgcgatcggccgccaccgccgcggccacgatccgttcggtggtggcggcccgttcggcggccgtggcgggcgcggcggctttggcgatttcggcgacgacggcatgccacgcggccgccagttcagctccgacgatctccagttactgttgcttgcgctcgtcgccgagcaaccgagccacggctacgagctgatcaaggcgctcgacacgcgttcgaacggtttctacagcccgagccccggcatggtgtatccggcgctcacgtatctcgaagaagtcggcttcgtcgcgtcgcaggcggaaggcaaccgcaagcggtatgcactgaccgacgccggccgcacccatctcgacgcccagcgcgaacgggtcgatacgctgttcgcacgcctcacgcacctcgcgcgcaagatggaattcatgcgccgtgcgttcgccggggaatcggcgggcaacgaaacgcaggacgaaacgcaagcaggctggctgccggagttcgtcgaggcgcgcctcgcactcaagcgcgcgttgctgcacaagagcgcagccggcccggatgaacagcgccgcgtcgcggccatcttgcgccgtgcgacggccgaaatcgaaggcggcaccggcgcgtgatccgcgccgccccgtcaaacctcaggagaacggattgatgcagaacacatccgagcgcaccgtgacccgcgtgcgccacaccctcaagttccgcttgctgcaggtcctgcgcgtgcacgccgtgacgccgcacctgctgcgcgtcacgctcggcggccccgatctcgcggatttcgaatccgcgtcgttcgacgatcacgtgaaggtatttttcccgccgcccggcgccgaacggcctgcgatgccgacgctcggcgcgaacggtccggagtttccggaaggcgaaccgaggccggtcgcgcgcgacttcacgccgcgccgcttcgatcgcgccgcccgcgaactcgatctggaattcgtgctgaaccacccgggccctgcgtcgcagtgggccgcacaggcacgcgtcggccaatggctcggtatcggcggcccgcgcggttcgttcgtcgtcccgaccggtttcgactggcacctgctgatcggcgacgatacggcgctgccggcagtcgcgcggcgcctcgaggaattgccggccggtgcgcgcgcggccgtcgtgatggaagtcgccgatcgcaccgcgcagatcgcgttcgacacgcgcgccgacgtgcatgaaatctggcgcttccgcgccgaagccgacgccgcgaacggcgacgtgctgctgaatgccgtgcgcgacctgccgctgccgccgtccggcgacggctacgtgtgggcggcaggcgaagcgctgtcgatacgcgcggtacgccagcacctgaccggcgagcgcggcgtcgacaaatcgcgcatccgcgcggcggcctactggaagcgcggcgcggcggccgtgcacgaaaccctggaagactgacggatgcgggtagccgtcaaaggcgtacccgtctgaccggcggatgacacaatcgtcgcgtcggcgcaccagcgggcttggcaccgctatcgcgactggtatatatctgtgtgtgcgacgccgctgtcgggcgacagccgtcgcagcccgcccaggagcgtccggtcatgacaaagaaagccccgcttcgcctttccttcgcaacctgaagatcgccggttattgcggccttgccgcggtggtactcgcgctgttcgtcgcgatgtgcgcgatcctgaaggaaagcgcgctcgaccgcgacgccgcgcaacatccggccgatacgcccgaactgcacgatgcgggcggcgggccatccgcatcggctgattcggccaggacacccggctgacggcgtccggcccgatctcctcccgcttacggcgcgtgtcggcgccccatcacgactgcatgcaccgaatcgccgagccgttcgagcagcgcagtcgcgcgttgtccgtacaggtgcgcggccagcgcgccggcagtgccgaccagcacgccgcccgccatgtcgaacggccagtgcacgcccgcatagatacgcccccatgcaatcgccgcggccaacgcggccatcacgaacccggtgagccgggtcgtgccgccgagcatcaacccgactgccatgctccacgcgaacgtcatgtggtcgctcggaaacgagctgtccggcgcatgcggaatcagttgcgtgccgacgccggccatgaacggacgcggcgagaaccagaaatgtccgatgacctgcgcgagcgcgatcgccacgcacacgccgacgccggcttcgatcgcctggcgccgcgtcgtgcgcgcgccgaagatccaggtcagcagcagcatcgcgggcagcgcatagacgagccagtcggcggcgaagatggcgaggcgggcaacgcccggctgcggcgcaaccccggcgttgatggcggaaaaagggtgagattgagggtctgcatgaatccggttgcgtgaggcgtaaaaactcggccggttgcccggcctgatacgaacgatgctagggcgctcccgcttaagcgatgcttaatggggcggacgcacgcgacgaagcccgccgcggcgaacgcacttagagcctgcactgcagcacaagttcacacaattgtcacattcccgcgcgaccgcctcccggaaaggctcacctgacgtcccgtaaagactcacctttttcacatcgtgacgtcatcgatgcatgcgaatatcgggggcaccggaggctgtccggaccgtttgcatcattcatctcaatatttacgcgtcgaattctacgaaatcggcaacaattaattccagatgcggcatcgcacaacggcaacgcacaggcataggattacgagcttacgagcactcatccacgaagcgatcaacaacaaggagtccgcatgaaacccagcgatgtccgatcgaaagcgtttgcgatgccgttgaccagccctgccttcccgatgggcccttaccgtttcgtcgatcgtgagttcctgatcatcacgtatcgcaccgatccggaccgtctccgcgaaatcgtccccgagccgctgcaagtcaccgagccgctcgtgcattacgaattcatccgcatggccgattcgaccggcttcggcgattacaccgaaagcggccaggtcattcccgtcgaatacaacggccagccgggcggctatacgctcgcgatgtatctcgacgatcacccgccgatcgccggcggccgcgaactgtggggcttcccgaagaaactcgcatcgcccacgctgcacgtgaacaccgaccacctcctcggcacgctcgactacggcaaggtgcgcgtcgcgaccggcacgatgggctacaagcacaaggaactcgacatcgacgagcagacgaagcgtcttgccggccccaatttcctgctgaagatcatcccgcacgtcgacggcaccgcgcgcgtctgcgaactggtgcgctactacatgcaggacatcaagatgaagggcgcgtggacgggccccgcatcgctcgagctggcgccgcacgcgctcgcgccggtcgccgatctgcccgtgctcgagatcgtcgaagcccggcacatcgtcgcggatttgacactgggcctcggcgaagtcgtctacgattacctggctcagtaacacgtccgcagtcctttctccctgtcaaacctttcaccacgggaattcgaacatgagcaacctgaatggcaagaccgcagtcgtcacgggcgccgcgagcggcatcggcaaggaaatcgcactcgagctcgcgaaagcgggcgcggccgtcgcgatcgccgacctgaaccaggacggcgcgaacgccgtcgccgacgagatcgtcaaggcgggcggcaaggcgatcggcgtcgcgatggacgtgacgaacgaggaagccgtgaacagcggtatcgacaaggtggccgaaacgttcggctcggtcgacatcctcgtgtcgaacgcgggcatccagatcgtcaacccgatcgagaactattcgttctccgactggaagaagatgcaggcgatccacgtcgacggtgcattcctgacgaccaaggccgcgctcaagcacatgtacaaggacgatcgcggcggtgtcgtgatctacatgggttcggtgcactcgcacgaagcgtcgccgctgaaatcggcgtacgtgacggccaagcacgggctgctcggcctggcccgcgtgctggcgaaggaaggtgcgaagcacaacgtgcgctcgcacgtcgtgtgtccgggcttcgtgcgcacgccgctggtcgacaagcagattccggaacaggcgaaggagctcgggatcagcgaagaggaagtggtgaagaaggtgatgctcggcaatacggtcgacggcgtgttcacgacggtgcaggacgtcgcgcagacggtgctgttcctgtcggcgttcccgagcgccgcgctcacgggccagtcgttcatcgtcagccacggctggttcatgcaatgaagccgcacgcccgcaccgaaaagcaggccgtcgatgcggcggacctgcatcacgaggccggcgcaccggccgccgcgcgcacgctgccgtacgaaacgatcgcgctcgtgctgcaaggcggcggcgcgctcggcgcgtaccaggccggcgtgttcgaagggctgcacgaggcgggcattccgctcgactggatcgcgggcatctcgatcggcgcgctcaacaccgcgctgatcgcgggcaatgcgcccgagcatcgcgtcgagcggctgcgcgagttctgggaaacgatctgcaagccggcgttcttcccgacggttccggccgcattcgagttcgcgctgttcaacagcatcgaccaggttcgtacgttcttcaccgcgtcgcaggccgcgagcgcgatgatgcagggccagcagggcttcttcgtgccgcgctttccgccgccgctgccgggcgtgtcggatcatccggagaagatcagcggtacgacacgtcgcaattgcgcgcgacgctgctgaagctgtgcgatttcgaccggatcaattcgggcgaaacgcgcgtgtcggtcggcgcggtcaacgtcggcaccggcaacttcgtgtacttcgacaactcgcgcatccgtctggcacccgagcatttcatggcgtccggcgcgctgccgcccgcgttcccgccggtcgagatcgacggcgagtactactgggacggcggtgtcgtgtcgaacacgccgctgatggaagtgctccgcgcacggccgcgccgcgacacgctcgcgttccaggtcgacctgtggagcgcgcgcgggccgctgccgcgcacgatggccgacgtcgccgagcgcacgaaggacgtgcagtattcgagccgcacgcgcttcgtgaccgacacgctgcagcgcgaacagcgctaccgcaacgtgctgcgccacgtgctcgagcaggtgccggaagagcagcgcaaggcggatccctggtgcgtcgaggccgatgcgatgtcgtccagcaagaagtacaacatccagcacctgatctaccagcagaaggcgtacgagcatcactacaaggactatcagttcggtctgtcgacgatgcgtgaccactggtccgcgggtctcgacgacatccgcaagacgctcgcagtcaaggacggcctcgcgctgcccaacaacgacgcgggcttcgtgacacacgacattcaccgcaaacggtaatgccgtgcgcgacggatcggcgcgatgcatgcgccggtccgtcctcttctccgatcagacatgccgattttcattgcactgttcgcgctcatcgctgccggatggggcgcggttcacctgtttcacgtcatcgccgcgcagttcggccagccggtcgcgatcgcggccgccgtgctcgccgccgcgatcctgatcgcgctggtcgcctggtggatcaagcgccaccgcgacatcgcaccgaatacgaaggaagaaggctggacccacgtcgtgcaccgcgcgtggggcgagctgcgcgtgtccgcgacgcaggggctgctgtggctgtcgcacgacggcgcggacggccgctatacgctgtcgcagctcgacggctgccaggccgcgccgatcggtggccgctggcacctcgtcgtgcacgtgcgcgatggcgtgcgcagcgaatggaagctgccgatgatggacaagcgcgacgcgcaacgctgggcgcgcgtgctgacgctcgcgaaggacaaccggctttgagacggcatgccgtgaatgcacgggcacggcatgcacgcatgaaccgccgcgccgcctggcccgcatgccggtgcgctatcgcgcgccgagcgcccacaacgcatcgagtacatgctgtgtcgcccgctcgaccggccccgcccgatgggcgatacccagttcacgccacaacgccgggcgcaacgcccgcatgacgatgcgcgcatcgggtagcggggcgcccgcctcgtgcggcagcagcgtcgcgccgtagcccgcggcgaccaggctcttgatcgcatcgttgtagttgagttcgatccgcggctccggccggtggccgccgagcgcgaaccattccgtcgtcagccgtgacaggcgggtggtcgcatcgttgagaatcagcgggcgggcggccagatagccggacgtcacgcgcgccggaagcggccagtccgccggcagaaacgccatcaccggatcgcgccgccacgcgcggatcgacagccccgcgaccgccgtctgcggcagcgccaccagcccgacatcgagcgtgccctgtgcgatgcgcgccagcgtgtcgtgcgacgtgagcaccgcgatctggacatcgatatccggatgctgctcgcgcaagcgggccaccgcctgcggcaacaggtgcgcgatcgccccggtcgacgcgccgaggcgtacgcgtccggtcaacccctgcacctgtcgctgcacatcgtccagcgtggattcgacctcggccagcaggcggcgcgcgcgctccaccagcacttcaccgataggcgacggccgcacgtttccacgcgtgcgggacagtaacggcgcgccgatgcggttctccagttcggcaatgtgaaggctgacggtcggcggcgcgaggtgaagcagttgcgccgcggcgacaaaggacccttggtccgcgatggcgaccagcgtgcgcaggcggtccaggctgatctcccgcattctccacctctcgttcaagaaaactgaatctgatggtcagtaaattcaacttttcctattctaggcgctcggtggacgatacggctttcccgacgaccgaaccgaaggaacgcgaccaccatgagccagcccactgtctacatcgacggcgatcaagggacgaccggattgcagatccacgagcgcctgcgcgggcgcaccgacctgcggctcgtcgcgctgccggaggccgagcgcaaggatcccgtgcggcgcgccgaagcgatcaatgcagccgacatcgcgatcctgtgcctgcccgacgcggccgcacgcgaagcggtcggcttcatccggaatccggcggtacgcgtgatcgacgcgagttcggcccatcgcacgcagccggaatgggtctacggctttcccgagatggccgacgggcaggcacgggcgattgcacacgcacggcgtgtcaccaatccggctgctacccgaccggcgcgatcgggctgctgcggccgctgctacaggccgggctgctgccgcgcgactacccggtgagcatccatgccgtgtccggatactcgggcggcgggcgggctgccgtcgacgcattcgaatcggacggcgcttcacacgcgaaaccgctgcagatctacggcctcgccctcgcgcacaagcatccgcccgagatccagctgcatgccggtctggcgaaccgtccgttgttcgtgccggcttacggtgcctatcggcaaggcatcgtgctcaccgtgccgatcgagttgcggctgctccctgccggtgtgaccggtgagcaactgcatgcgtgtctcgcgcaccattacgccgagtcgcgccacgtcgacgtcacgccgctcgcggacacgcatgcgatcacgcatctcgatccgcaagcgctgaacggcaccaatgacatgcggctcggcgtgttcgtcaatgccgagcacggccaggtgctgctgtccgccgtgttcgacaatctcggcaaaggcgcatccggcgcagccgtgcagaatctcgacctgatgctcggggcggcaggcgcggcaaaagcggcgtaagccgtgtgcgggcaccagcgtcggctggcccggcacctcgcgaccgcgatgtgttgatacccgttcgccgcgaccggctcgcgacgcggttgcgagccggaaacggggcctgccgatgctgcgcacatgcccccgtaaagctcacctttagccggtttcaggccgtatcgtcacccgccgcggcattcaaaccggccagcgtctccatcagaaaatccacgcacacgcgcactttcgccgacgccgcgacgcgctccggatacacggcccagatgttcgcgggctggattgcgtccggcagcacgcgacacagtgcaccgcgttcgatcagcggcgcggcttcccagatcgaacgcagcacgatgccgcgcccggccagcgcccattgcacggcgacctcgccatggttcgtcgacagcgcgccgccaaccttcaccgtggccgtttcaccgcgcacgttcagccgccacacgccgaacgggtgatcgcgctccttgatggcaagacagtcgtgcgatgcgagatccgcgagcgagcgcggtgtaccgcgccgggcgagatagtcgggcgacgcacacagcacacggtagttcgcggcaaggcggcgcgcgatcaggtgatcggcgatctcgtcgccgatgcgcacgtcgaggtcgtagccttcgcccgcgacgtcgacgagccggtcgaacagatcgagccgcacgttcagttgcggatagcgtgccgagaagtcgagcagcgccggcgcgacgatgtgccggccgaagccgaagctgctcgaaatgcgcaacgtgccacgcggcaccgtgcgcgtcgtcgacacgtcctcgacgagatgatcgacgtcgtcgagaatcttctcggcgcgcgcgaacacgcgctcgcctgcttccgtgaccgtcacgcggcgcgtcgagcgatgcagcaggcgcgtgccgagctgcgcctcgagcaacgcgatgcgcttgctgacataggccggcgacaccgcgagctgctcggcggccgcgctgaagctggtcaggcggacgaccaggctgaacacgcgcaggtcgtcaagattcggcgatttgttcacgattcgtggaaagtcgattaacctttcgcgcgattttaatccagatggaaataaatagaatgacgtgacgcgccgctgcctctccccgcggccagcccaccagccaaggagctttgcatgaccgacaggacctacagaattgccgtgatccccggcgacggcatcggccgtgaagtgatgcccgagggcctgcgcgcactcgacgccgtgaccgcgcgcttcggcatccgcttcgacttcgtccagatcgactgggcaagctgcgactactacgcacagcacggcaagatgatgccggacgactggaaggcacagctctcgggcatggacgcaatcctgttcggcgcggtcggctggcccgcgacggtgcccgatcacgtttcgctgtggggctcgctgctgaaattccgccgcgaattcgaccagtacatcaacctgcggcccgcgcgcctgttcgacggcgtgccgtcgccgctcgccggccgccgcgcgggcgacatcgacttcatgatcgtgcgcgagaacaccgagggcgagtattcgtcggtcggcggcacgatgttcgaaggcaccgatcgcgagatcgtgatgcagcaggcgatcttcacgcgtcacggcaccgagcgcgtgctgaaattcgcgttcgaactcgcgcagcggcgcgcgaagcgcctcaccgtcgcgacgaagagcaacggcatcgcgatcagcatgccgtggtgggacgcgcgcacggccgagatggccgaacgctatcccgacatcgccgtcgacaagcagcacatcgacatcctgtgcgcgcgtttcgtgctgcagccggaccgcttcgacgtcgtcgtcgcgtcgaacctgttcggcgacatcctgtcggatctcgggcccgcgtgtacgggcacgatcggcatcgcgccgtccgcgaacctgaaccccgaccgcacgtttccgtcgctgttcgaacccgtgcacggctccgcgcccgatatcaccgggcaatacatcgcgaacccggtcgcgatgatctggtcggcggccctgatgctcgacttcctcggcaacggcgcaggccgcgaacgcgaagcgcacgatgcgatcgtcgccgcgatcgaggacgtgctgcgcacggggccgcatacgcgcgatctcggcggcaacgcgaggacacaggaagtgggcgaggcgatcgccacgcgcatcgcgggctgacgatcaggcccggcgcaatcgcaatcacacgcgccgggcagaggctgcacgaatcggtgtgcggtgagttgcacgccatgcgtttgcgcacgtgtgcgaattcctgcgcctgcctggtgaagtcgagcggtgagcaacgtcgcaccgcaacgcgcacggcacgcgccatcaggcgtcgacgtcgatacgatcggtgagttgcacgccacacgcgtgcacaccgatcgtcaaaccgctaccggccccgatcgatcggtgagatgcatcacgtggtgaagcacaccgttgcataccgatacgcgcatcacgagatcgcgacgtgcatggcatgtccgctttgcccgggacgatgccgcgtcgaacggctcgaagcacacagtccgacgcgacatttccctcgtcccgaaaaacctcaccttcagcgcatcgactcccgaatttcctcaccgttgaagcccggtgatgcgttcgccggtccgtcgagtcgacacgcgcgtcacaggccgagatcggacagcccgggatgatcgtccggacgacgaccgagcggccagtgatagagacgatcctgctcgcgaatcggcaggtcgttgatgctcgcgtgacgatgcgccatcagcccgttttcgtcgaactcccagttttcgttgccgtacgaacggaaccagttgccggcatcgtcatgccattcgtacgcaaagcgcaccgcgatgcgattgccgtcgaatgcccacagctccttgatcagccggtagtcgagctcgcgcgcccacttgcgctgcagcagcccgacgatctcgtcgcggccggtcacgaattccgcgcgattgcgccatcggctttgcggcgtataggccagcgacacgcgctgcgggtcgcgcgtgttccacgcgtcctcggcggcgcgcactttctggcgcgccgtttcgagcgtgaagggcggaacgggcggacggacttcgagggaagcggacatgggttgctcctgttcaggttctggccacggacgaccgcggccggttcggattcgctgcttcgactaccgtgataccgcgtcgagcagcagttcggccgtcgcgcgcgcatcgcgcgcggcgtttgcatcaccactgacgagcgccacgccgattgcgccgtcgatcagcacgagccactgacgcgcgatgcgcgcgagcccgcggcgctcgatgccggtttcatcggcatacgcatcgaaccgctcacgcacgaacgccagcaagcgcgccttgtgcgcgcgtgcgacgacgcgcaccggatcgtcggcatcggggatctcgcccgatgcgttgaggaacgcgcaaccgtgaaagtcgggttgcccgaaccagtcgcgcagtacgtcgaacatgccgagcaactgaacgcgcggtgccttgccacgcgccagcgtcgcgtcgacgaaccagcgcatccagcgctcgtcgcgacgttcgagcgcggccaacaccagcgcctctttcgattcgaaatgcgaataaaagctctttcgcgccgcaccggatcgcttgacgatcgcatcgacaccggttgcatggatgccgcccgagtagatcagcgcttcggctgcatcgagcagccggtcgcgaacgcccggttcgccggaagggtcgtgatgtgtgttcatgggtttacggtagaacgatcgttctccaccgtcaacacccggatgaaaaagccctgctggcgggagggctgaagcgcgacctggccgcgcgatgcaagtccgccgcgtttacgacatttttcttgaagcggacgcgcgacgctcactacacttcggtcaccctgtctgggcgaaaggacatcatgcagcgaccggaatccgcgcgccccgcgcgcgcctatgcggcttatgccaagcggctcgacggccgcgtcgtcgtgcggcgcttcgacccgcgcaacgattcgtacgacacgttgaccgcgctgctgcatcgcgccttcgcaccgctcggcgcactgggcttcaactgcccgtgcgtcgatcagccggcctcggcgacacgcgaacgcgtactcaccggcgagtgcttcgttgcgctcggcaacgcgcacctggtcgcgacgatgacgatgcgttcgcacgatcccgattcccgctgcgatccgtaccgcagccggcacgtcgcgacgctcggccagctggccgtcgatcccgtctggcaggaccgcggcatcggccgatcgctgctcgcattcgcgcaacggcgggccgccgcgcgcggcgcgacgcacctggcgctcgacgcaccttacgcggcggtccggctcatcgatttctatcgtcgcgaaggatttcaaccggtcgacgtgatgcgctttccggggcacaactacgacagcacgatcctgtgcaaatcggtctgcgtcacgagcggtcgcatcgttgccggtgatacgacgcggatcgacgttgcacgacctgtcggtgccgcgtcgtgaaacacgacatgccgaagcgcgaaggcggcgacgatcgcacccggctcgccgtccggcaggcacgcgtgcgcgctgcactgcggctgcgtggcgtgttgaagctgacgatcgtcacgatcgcggtcgcgcacgtgctggcattcgtgttcgacagcctgctggtcgtggccggtttcgcgccggatgccgcggcggtgctgctgttccgtttcgtgacgtgcgcgctggtcagcttctggctgcaagcggatgcgttgcgcgcatatcaatacgcagcgcaacacgggttcgtcaccgcgcccggagtgcacggcggcccggtcgacgttgcaccgcagtgtccgaaacgctggctcgtcgtgttgagtcttcagctcgatccgcgcgggttgaacggtgaacggatcaagtagccgtcggcgcaccgatcgacgtcgatcgatatcgaatggtttcacgcatgagtgagtcgcaacgacgcgcgcgggctcacggttgacgccatggttcggcacgacatcgcatgcgcttgcatgacgagcgatcgcgcggcaaggcaagcagggaagtgtctggaagggagagcaggtgccagacggcgtgagggcggaaagcgacgcggcttccgtcaggtgaaatgaacgtgctaccgcagttcaccgatgcgcaatcgtgtcgcgattcggcgcgccaacacagctcccgaataatctcaccttgagcctggactcgcgcgtttcggcctcggaaacgcagacgtaaacgaaagcggggcaggcggcgaacacgcagcactgccccgcggcactcaggccgtccagtcgagaatcaccttgccgctctcgccggacagcatcgcggcaaagcctttctcgtaatcgtcggccgcgaagcgatgcgtgatgatcggcgacaggtcgaggccgctttgcagcatcgcgaccatcttgtaccaggtctcgaacatctcgcggccgtagatgcccttgatctcgagccccttgaagatcacctggttccagtcgatcgccgtctgcgcgggcggaatgccgagcagcgcgaccttgccgccgtggttcatcgcctcgagcatgctcgtgaacgcgctcggcacacccgacatttcgaggccgacgtcgaagccttcggtcatgtgcaggtcggtcatcacgtcgcgcaacgactcgcgcgcgacgttgaccgcacgcgtcgcgcccattttgcgcgcgagttccagccggtagtcgttgatgtcggtgatgacgacgttgcgcgcgccgacgtgcttcgcgatcgctacagccatgatgccgatcgggcccgcaccggtgatcagcacgtcttcgccgacgaggttgaacgacagcgccgtatgcgtcgcgttgccgaacggatcgaagatcgacgcgagatcgtcggagatctcgggcgggatcttgaacgcgttgaatgccggaatcgccagatactcggcgaacgcgccttcgcggttcacgccgacgccgaccgtgttgcggcacagatgccggcgccccgcgcgacagttgcggcagaagccgcacgtgatgtggccttcgccggacacgcgatcgccgatcgcgaagccgcgcacttcctgccccatctcgacgatctcgccgacatattcgtgaccgacgtgcatcggtacgggaatcgtcttctgcgcccagtcgtcccacttccagatatggatgtcggtgccgcagatcgccgtgcggcggatcttgatcagcacgtcgttgtggccgacttcgggacgcttcacgcgcgtgagcgtgaggccggggccgcgttcgagctttgccagtgctttcatggtcgcgcctccgtcagatcacgccgagcgacttgccgacgcgcacgaacgcggcgaccgtctggtcgatctgttcaggcgtatgcgcggcgctcatctgcgtgcggatgcgggcgcggccgcgcggcacgacggggaacgagaaaccgatcacgtagacgccttcaccgagcagcttgtcggccatgttcgtcgcgagctgcgcatcgccgagcatcaccgggatgatcggatgcgcacccggcacgagcgtgaaaccggcttcggtcatctgcttgcgaaaccgcgcgccgttctcgcgcacgcgctcgcgcagcttcgcgccttcgtcgctgccgagcagttccagcaccttcagcgatgccgcggcgatgctcggcgtaagcgtgttcgagaagagatacgggcgcgagcgctggcgcagcagctcgacgacttcgcgacgcgcggcgacatagccgcccgatgcgccgccgagcgccttgccgagcgtacccgtgatgatgtcgacgcggccttcgacgccgcagtgctcgggcgtgccgcggccgtgcgtgccgatgaagccgaccgcatgcgaatcgtcgaccatcacgagcgcgccgtagcgatcggcgagatcgcagatgcctttcaggtcggcgatgatgccgtccatcgagaacacgccgtcggtcgcgatcagcttgtggcgcgcgcccgctgcatcggcttccttcagcttcgcctcgaggtcggacaggtcgttgttcttgtagcggaaacgcttcgccttgcagaggcggatgccgtcgatgatgctcgcatggttcagctcgtcgctgatcaccgcgtcgttctcgtcgagcagcgtctcgaacagcccgccgttcgcatcgaagcagctcgaatagaggatgctgtcctcggtgccgagaaaggcggccagcgcgctttccagttgcttgtgcacggtttgcgtgccgcagatgaagcgcaccgatgccatgccgaagccgtcctggtcgaggccggccttcgccgcgtcgatcaggcgcggatcgttcgccaggcccaggtagttgttcgcgcagaaattgagcacgccggcaccgccggcgagccgcacggctgccgcctggggactcgcgatctcgcgctcggtcttgtaaaaaccgtccgcgcggatctggtccagcgtcccgcgcacctgggcgagaaaggcatcacgcatcgcaaagctcctgacagggtttcgcattccgcaacgcgccactcgtggcggcggcgcaacggcctgctactgttatagtcggtcgttcggttgaccgcatttatccgatattccgaactagaattcgaaataccgaacaactctaagcgaacggaatccaaatggcaagttcctccggttcgcggcgcacgcctgccagcgccgcaccgcaaccgccggccgccacgccgccgcgtgtcggcgagcagatccagcggctgcgcaacgaacgcaagctgacactcgacgacctgtcgcgcgcagccggcgtatcgaaatcgatgctctccgagatcgaacgcgacaaggccaacccgacgatcgccgtggcgtggcggctgacgaacgcactcggcatcacgctcgacgagctgttctcgcaaccgaaggcgcccgagactatccgcgtcgacggcccgcacgacattccgacactcgccggccatgacggccgataccagttgcgcgtgtggggcccgatcgacctcgccggcaagttcgagtggtacgagctgacgctgccgggcggcggcgcactgatatcgaacgcccacgagcccggcacgcgcgagcacctcaccgtgctgcagggcgcgatggaaatcgaagccgcggcggcaagccggcgcctgaaggtaggcgacacagcgcgctacccggccgacgagccgcacgcgatccgcaatcccggcaaggccgaggcgcgggcactgctgatcgtgatacaccgctgacggcgcggatagccggccgaaaggccgattgcaggccagttgcggaaaacactgtatgtttgtacagtatacggacattccgccatgcatgggctggagctggcgcaccgaggcgcctgcccggtcgacaggagcctgcaatgacagaagaacaagatttggccgcgctcagcttcaaggctgccgcgcacgacctcgagctgatcgttcgccatatcgccgggcgttatatccgccagcgcgtcccgctgacgtggcgcctgctgcatgcgatcgaagccgaggcgcttgccgatctcggctttgccagccggcacgaggccggcatgcgtcaattgttcgaacggccgtcggacatgacgtttcccgaaacggacgatccgatcgacttcgggcgctcgaacgcgctacccgccgtattttcgttcgcggttctggcatacgaagccgcgtcaacctcgaacgacaccgcgcctcgcgagcgggctcaccgcccgtccaaggcgtggggcgactgactgcccgtccaggccgccacgcgtggcggccttgtcctgccccttgcctcttgatgcccgagacgttgcggaaagggctaccatacacgcaactaacggaataaatcacatgtctcttcccgcctctcccgacataccggcacgcccggaagaaatggatctgttcgaccgcggcgcgtccgactggatcctctctcccgaagctgcattcgatgcatggctcgccatgcaggactatcgtcgctcatcggccgacgtctatcgcgcgcaatggggcgcgtttctcacgtggctgcgtacgcaccagaagaatctggcgacggtcgatacggcaaccatcgcgaatttcgtcggcgaactcccgatccggaaaacccagcggatgcgctatctgcggctgatcgagcgcgtgctcgaccatatccggcgcaccgaatacgcgtcgaccaacccggcccggttcattgctcaggatggcgaagcgaactggcgcaaggctcgcgacaacgaacctaccggtttcctcacgccggccgagcgcgcgacgttgctcacgtacctgttttcgccgatcggcgtatccggttccgcgtactggaaagagcggcgcgaccgcgcgctcgttgccgcgtttctcggcgccggcattaaaaccggtgaagctcgtgcacttacgattagttgcatcaatacagctggaacgtcgctgcagatcgagtcgacgcaccctgatttcgcgcgcgaaacccatctggcgtcgttcgcgatcgccctgctcgaagcgtggctcaccgaacgcaagcgccaggagattcccggtgagctcgtgttcccgcatcccatgccgggcggccgatgcacaaggcgacgatgctgcgcgccatcgacgcgatcgtcgaatccgccgggctcacgtcgtcacgcaccgcacgcgccagcccgcaaaccctgcgtaatacctacgcggccgaactgttcgaacacgacgtgccgcccgaacgagtcggcaaatggctgggcttcatgcgaccgatctcgtcgaaccgtctgcatcgcgcatggaaaaactggcgcgacggtctggccgacaacaatgccgacggtgacgcgtcgggcatcgacgaaactcactgatccccaaacagctgctcacgccaagcgatccgtgagcagccttgtgcggcacagcctcaccgttcaatcgctcccgaaaaacctcacctcaagctccccggatcgtctcacctgtgcagtgccgccgcccattgcgtcacgtgcgcacaaagcgggcgacggcttccaatcgggatggccacgcgcccgaagcgtgttcgcactcggggcacgccacttcaaaaccctcttttccgtgtgacagctcgggctcaccgtcgcaatgcggacaatgggccggtaccggagtctcttgatccagtgaggtgccgatcgcggcaaacgcctccgcatccagttgcccggcatcagccaggcggcggatcagcgcggcgatttccggattcattccgcggctcgcgcgcagcaaactcacatcgcgcgtcgcgcgttccagttcatctcctggctgcgcaattgttcttcgagccggtctgcgcgcgccttggcagcactcaattgctgcaaaatcgaattccttgcgctgaacgtcgcgtaagccgttctggtaggtcgacgccgtgctgcgcaacgaatccaactcgaccagcatcggcttgacgcggcgttcggcttcggccaccgcgtccttgatttgctgcgcgtagtgctcggtgcgctgctgcagttcggcttgaagcgcatcgatgcggtcgcgcagcgtggcgttctgcgcctgctcggcttcgacacggccggccgccgcagccagctccttctccagtcgagcgactgtggtgagtaacgtcgcttcgcttgccgaaccgtgcgtcgtttgcgatgcaagctggacttcgagttcggtcacgcgcgcctgcaattgctcgtttttcgcttcgccacgtgcgagcgcgccttcgagcgtctcctggcggacgattgcgtcgcgcaatcgctgttcggcgtcggccacgccggcgcggacctgttcgcgatcgccatcgaggctgtctcgcgcggctttcaacgcttcttcatagagtgccccgagcaacgcgccggctttttcctcgacggctttcggaattgcggcaccgtcgagcctgaccttggaggcggaacggatacgctcccagaaatggtcgatgtctttcgggatatcgctggcgctgccggtctgggtgagatcgcggacgttggcagccgacggccggatgccaagatcgaagaacaaccgcttgcatgcatgcagcgacaattcctgccgtcgcgcacctcttgcacgcagcgattccagttcgtcccgaatggtttggcgtatttcgtccagggtcatcgctgtgctcacagacattgaagtgtggcaatcataacgaaatacgtacttatcgatacttgtttcggctcggcgttgtgaatttacgtcgcttcgcacagaaatcggatctgtgagccgatctggtcgactgtggtccaggattccgtgaaacaaagcgaagaaagttagccaagtccttgtcgtgcaagcgtttttctgtcgatcccgaatttcggcatttgtttcacatgaccacggctccggttgcttgtcggtgttcaggggttggggtgtctgtggaaaactctgcagctgatgtcttgagagtattagaagtaaacacccttgaacccttagttaaaaacgttaacgccacggcacagccttatgctgcaaggctttccggccgacaaggtgaagttttacgggagccaaggtgatcttctgcgggagctgaagtgatggggttcaggagctgcgtgagccgttgcgggaaaggtcgtgagcggattcgggatcacagtgaaacacgagatttcccaaaggtgaggcttttcggggcctcacagccacagaacccgcgctgtgcctgactgcacagttttctgcctgtgcagacatgggtgagaatttgcgggacctttttgtgccccgattctgcccatcttttaggcagtttctgtgaaaggtgaggtttcacgggactccacgggtgtttggtgtgaggatttccgggaaagggacgccattttgcacagcaaaagtgctctcatgggcctgtgatgcactaaaggtgaggtttttcgggaggaaatccgggttttcctgcccggatcccgctgaggtgagctttttcggggcatggatcacagactgtgattcgggccacaggtgagcctttccgggaatggaatttgctcgaaaaatggtcaaaggtgagcgttttcgggatccgtggacggccgaattggccgaaaagcccgccaggactggaagaaatctcgtttttgctgtgcctcttttggcacaggtgagatttttcgggggcgacataccgttgtcgtatgaaggattttcgtcgaaaggtgaggcttttcggggatgtcggcggtgcacagccaaatgccttctgtgcataagtatcggaaggcattgaggtttttgataccgcgtcggttacggtgaggtttttcgggagccatttccgtgccagaagtggcacagcgatttttcggtaaggtgagcgttttcgggaggctctgatggcggatcccgcgcgtgtcgggcattcgtcggcattcagatgaatgaacatgctgtgctcaaggtgagtttttcgggacccgatacggtttgtgcgctgtacaatgcgcgcccgggccgacacagcaggttcgttcgggtcccgcaggccggtttggcgggcgtcttccggggcggcgaacccgatcacgatcgcccggagagtcgcgcctgtacatgcatacaggcctgaacgggtcgtatcgggaagtgcgatgaggtgggatcgcaaccctgtgccgaactcacggcagcgcagtcgtaaaattacgacaaatcgaaaggtgagccgatacgggagtgcatttcgcacgttccgggcacaggtgaaattctgtgaatcggcgcatcccgcagcacgtctggacgagtccggaacgctgcaaatccggaccggtgaggattttcgggagcgcctggggtgagtgccgttttacacgcgcacttcacccgctatggtgagcatgtcgttctggacgcacttcaccgcagacgctatccttccggaaaacttctcctccgacccgacgtatggccacgacgaagcgcgccaagaaaaccgatgtggatgtggtgagtgccagttcagccgaattgcgtaaggccgtcgaggcgatcgcaattcagccgaagagcggcaagatcacgctcctcactcgcaagctgttcaatgtcctgctggccgtggcgcagcaggccgacgactcgggcgatacgtatcgcgcgctgctctcggacatcgtcgccaactccgccttcgattcgaacgacaccgcgctggtgaaggaacacctgcgccgcatggtgtcggtgcaggtcgaatggagcacggggacgtcgagccagaagccgggacgcaagtggggatctcgacgctgatcgccgacgccgaaattctcgaggatccggcgacccgccgcgtgtgggtcgaattctcgttcgcgccgaagatcaagaaaaagctgctcgacccggtccagtacgcgcgcctgagcctgcagttccagagccagctgcgcagcagcgccggcctcgcgctgtacgaaatctgcgtgcgctacctgacgaacccgagccacctgacgatgcgtgagccgtgggaatggtggaggccgatcctgtcgggcacgcccgacacggaagccggcgacgaagcgaaacgcgagtacaagtacttcaagcgcgactatctgcgtcccgcgatcgcggaagtcaacgcggtcaccaacatcttcgtcgagctgatcgaacaccgtgaagggcgtcgggtcgcggagatccagttccgtgtgaccgagcgcaagcagccgatgctcgcgctcgacgaacatccgaacgtgttcgacagcacgctggtcgaccggatggtgaagatcgggatcccgctgaaggaagcgcagacgctctatgcggacagcgaggaaaaccgcattcgtgccgcgctgcagatgaccgagcagcggatgcgcagcacgacgctgccgccggtgcgcagcgcgccggcgttgttcaaggatgcgctgaagaagggttatgcgccgccggtcgaatcggtcgacgcactgcctgccggcacgccgcctgcgaagattgcggcggcccagccggacgacctgaaggcacgcctgttgagcgagttcgctgcgttccgccgcaaggaagcgaaggtgctgtacgaagagcagggcgacgccgagcgcgaagtggcgcgcgagtcgttcgagtcggaggcgctgccgacgatgggcacccatctgcgcgacgactggcgcaagcgcggcctcgattccaagctggccgagacggcctttttcgactggctggcccagaagacctggggcgagccgacggacggcgacctgctgtcgttcacgctgaaccagtcgcgggccgcctgaggcccgctcaggcccgctgacgggccgccgccggccccgccctcggttggcggacccggcatcttcaccaggcccaaccggccgtttccgtcactccgacaacagcatccgctcgagctgctcgaggatcgcgtcgcgcttgtccttcgggaggccgcgcaggcgcagttcgatgcgatcttcgccatacgacttcaggtcgccgaccgacttgccgccaagcttgatctcgagacgctgcgcatagcgctgacggccggcagccttcggcgtttcctgcgccgcgacgcggcccttgacgatgtccgacacctggcgtgtgctgagatcgtccgacacgatcttgttgatcaaccgcagcgtggcctcggtgccgcgcgcattgtgatagcggccgacctgatacgccatgtttgaaccgaagcgatcggggcgcgcgaccatttcctgcatgatcgcttccggcagtttgccgatcgacagggcgacggccaccgtcgattcgtcgaggccgaggtgctcggagagctccttctggctctggaaatgcttgtcgtcgaggaagcggcgccacacgacggcgttgtcgaacaccgtctgcgaatcgcgctggacgttgagatcgtagccgagcttgtagctctggatgccgatcggcacgtcgatcacgatcgccttgaccgattccttgttggcttccttcagcgcccgcacgcggcggccgccatcgctgacgaaatacgtgcccggattgtcgtaatccggaatcacgtggatcgcctgctgttgcccttgcttcgcgaggttgaccgcgagttcggcaatcgacgatttcagatagaagtgccgcggattgaacgggctatgcttgatcgccttcagcgacagctcgatcacctgcccgggcgcatagcggttctcgagacgccacgcacggtattgcgccgattcatcgatcgacggatcgagcgtgagctcgggagctggctgcggcgcggtgtctttctttgccgatttggtcggcgccggggtggggtctcggacttgacgatgccgtcgatcgcattgagtcgatcgagcgccgtgcgcttctcgctcgtcgtgatatccgggcgcgcttggaatcctttggcaaattgggagggtttcatgtgactcctttgtgcgcataaagtcagggcagcatggcgacgatttcgtcggcgcatgcgcgaatttccgtggcggccagcttgccgccacgatcgttcatctgcagcacggtctgaccgagcgccatcgcctgcttgtacgcctcccgggtcgggatctgcgttttcagcaacgggaagccgagttcctcgagcgcgcgcttgagctcgcgggtcagcatgcgcttctcttcggtcttgttcagcaggaagactgcgcggaggtcttcgttcatgacctgcgcctgctggatcagtttgaccagcccaacgctcgaccagtaatcagccggcgacgacgacgtcggaatcacggcaatcgatgcggccagcaggacgacgcccgacaccttctcggtgatcgacggcgggcagtccacgacgatgatgtcgtagtcgttgatgaacttcttgatctcgcgatggatctggccatcggcttcggcaaggttgacgaccggaaacgggatgccgttttcgctgtcgccggatgcgctcgaccagtgaaccagcgtgttttgacggtctgcgtcgatgacgaggacgcgcttcccttttcatggaacgcggcaccgaggtgcatggcaatcgtgcttttgccgacgccacctttttgttgagtgactgcaatgatttccgcggccaattttcactcctattttggtcgttggaattctacaggacgatatttgaatttcaatgaaattgtcgttcgacaactacccattggccattcgggctatcggtttatgcgcataaacgaaccggagatggcgagtggcccgattggatggtgtggcggatgtctgtaacgtcgatgaacggggcggggtttgagtcatcgagtgtggcgtcgctggtgtgagtagcgagttgccgcgggatcgtggtgtgctgccctttcgttcgatgaggcggttggggctgagagctggagagtttgtgcgcataaactccgctgaaaccgcggctgtcggccgcgtgaccgggggaactgcacctctgagagtggagtgttagcggtatgtcctggcccggtacaccgcgttgaggcatgccgctgaacccgtgtacgtcggcacacctcgctgcctttgggcgtctcgtttatgcgcataaactgcggccgatggcgatggcgatggcgatggcgatggcgatggcgatggcgatggcgatggcgatggcgatggcgatggcgatggcgatggcgatggcgatggcgatggcgatggcgatggcgatggcgatggcgatggcgagcggcgagcggcgatggcgagcggcgaaagatcacaccccgactgctctggaatccagtgcgcggcgattgaccagcgggcatgtcgacgtagcaatcgcatccacgtgaggacgtttccactgttaccacgccgcgaatcgagcgctgcctcgcccggcaaccgcccactttatgcgcataaaccaaccgacgtacgacgcacccgcccgcctcctttccggtcggaacctcccatcgtattgatctggcgtgcggcacctcgatccgtcatcccgcggcagaacaccgctcacctttatgcgcataaacacatcaacgcaacgccgtgaagcgcatcccgaacagcactccctctcatggtccgtcgcacgacctcgtccatctgcttccgcgaagcagcgaatccactcgaaatcccgcgatcccgcgccaacctccccgcccagacacccgatgcagactggctacaatacggggctctaccctccaggcttgaatgatgatcacgatctaccacaacccccgatgctcgaagtcgcgcgagacgctcgctttgatcgagtcgctgaataccaccggtgcgcctctgaatgtcgtcgagtacctgaagacgccaccgacggtagaggaattggaagcgctgcatcggcagcttggccgcccggttcgagacatgctgcgcgacggagaggaaccgtacaagacgctgaatctggcccgcgccgatctgaccgacgcacaagcctacgcggcgattgccgctcatccgattcttctgcagcggcccatcgtcgtttatcgcggcaaggccgccatcggccggccgcccgaatcggtgcaggcgctgttcgaataattcttgcccgccgtatttttctgattgcatcggccgggtacaaacatcggcattcgaagccgatccgatcgccggacaccatgcgaccaccacccgggcgatcgcaaccaagcaagccgcccctagccttccccggacgacccgtcgtcgtcgtccggcccccgcccgccgccgctttcgcggctgtccgcagcagtgcgatctgaccgcgataggccctgcagccactgcaggtcggcaggtgtacacgcacctgcaggcgctcgtgcagggtcagatgccggtccagcgcatccgacagcagtcgcgtcacgtcagtacatttccccggcagcatcttcggtcgtcagtccttttcactgaggcaggttcgcaggcgcgtgcgcgcccgatacagcagcacgctgcaatgattcgtcgtcagcgtcaattcgctgcagatgtccgtaatctcgacgtcgaggaattcgcgcatcatgaacacgcgcccgatctgctccggcaggtggtcgaggcaggtctggaacagcgtccagaactgctgctgctgcaacagcgtttccgggcgcggccacggtcgcggcttcgcatgcgcggcccagtgcccgttttccttgaacagctcgcgatcgagcaccgattcgccgtcgagctcggcatcgagcgccgacaagctcaccgtgcgctgccgcgcgcgcagcacgtcgatcagcttgttgcgcaggatgccgaacacccaggtcttgtgggccgacagcccggcgaaatcgcctgcgtgcgaccacgcggcggcgagcgcttcctgcacggcgtcttcggcagcgtcggcatcgcggagctggagtcgcgcgaagcgcagcaggtcgcgccgcagttgcgcgagataggcgggatcgtcgtattcggacggcatgtctgggttgcggtgtctcgaggcaatcgtgtgcgccaccaagcgggcgcgtcgcggtgcgagcagcttactgggcgcggtgcccgcctgcaatgcatgttccgtcacgaattcacgaaaccggtcgacgcgctgcgctatgcttgccgaaccctgtgtcgcgtgtcgacctcgacacgcggcgggcagtttgtaacgtcagatcataacggtcaagttatccacaatttctgtggaaaaccttgtggaaagtcggccggccggccccgtggggcggttcgcgggctggcttgcctataaacagacctttgtcgctcgttcggaagcaatcgatccgattcctcactcaccggaaggagaatgtcatgccctatcgcatcgctgtggtcgtcggcagcctgcgtcgcgcttcgtggaaccgcgcgctcgcgcacgccgtgatctcgctcgcccccgccgatttctcgttcgagttcgtcgagatcggcgaactgccgctgtacagccaggactacgacgcggatttcccggaagtcgcgaagcgcttcaagcagtcgatcgaagccgccgatgcgctgctgttcttcacgcccgagtacaaccgctcgattccgggcgtgctgaagaatgcgctcgactggggctcgcgcccgtggggttccaattcgtggtcgggcaagccgggtgcggtgctcggcacgtcgccgggtgcgacgggtaccgcgctcgcgcagcagcacctgcgcaacgtgctcgcgtacctcgacgtgaagacgctcgggcagcccgagatgttcatcaagcacgatccggcacgcatcgacgatcagggccagatcgtcagcgaagacacccgcaagttcctgcagggtttcgtcgatcgctacacgggctgggtgcgcttgctgaagtcggcctgagcgtcgccccgttcatgccaccggcgccggcccgcgcgtagcgggtcacgtgccggcgtgtcgcgcgtgccgtgcgtcgcgcgcttcgcggatgcccagcaggatctcgtcgagcagcgcgatgtcgaacggcttcgacagcacgcggacgttgacggtgcgcgtgcggtcgagttcctccgcgtaacccgtgacgagaatcacgggcagtttctccggccgcttctcgaccgcttcggcgaggtcgatgccgttcaggctgcccggcatgtggatatccgaaatcacgaggtcgaacgcgtcgttcgcagccgcgccttcgatcaggcgcaacgcgtcgtcggcggtgggcgcgtaggtcacgcggtgcccgagcagcgacagcagcgcttcggtgccggccgcgacttcgctgttgtcctcgacgagcagcacgtgcaggccggcgagcgcgcccgtgcccgcgtcgtgcgcgaccgccggcggccgtgcgacgacatcctcggcgcgcgcgcgcggcaggtagaggcgcaccgacgtgccggcaccgaccgcgctgtcgatcgtcgcgaggccacccgagcgttcgcagaacgcgaatacctgcggcaggccgagccccgtccccatccctgagccttcgtcgtgaacagcggctcgaacgcgcgggcgagcacgtcgggcgccatgcccgaacccgtatcgtcgagcgagatctgcacgaaatcgccggtcagcggaaagccgtcctcgcgacgcagcgtcacgttgcgcgcgccgaccgtgaagcggccgccggccgccattgcgtcgcgcgcgttgaccgcgaggttgattaccgcgagttcgagctcggcgacgtcgacgcggatcggccacacaccgggctcgatcgcgacgaccagcgacgatttcgaaccgagcgacgtcttcagcagttcgcggcatgtgccgacccattgcccgacgtcgatcgtctcgttgtgcagcggctgcttgcgtgcgacgccgaggagctggcgcgtgagcgactgcccgttcttcagcgcgcgttcgatcgcgccgagctccttgtcgagatgctggaccccgcgccgccgcacgatctgcacgttgctcgagatgatcatcagcaggttgttgaaatcgtgcgcgacgctaccgacgagattgccgagcgcctgcatcttgcgcgactgccggtacgccgattcgatcgaacggcgcatcgacgcttcggcctgccagcggtcccacgcctcctcttccgccttcagccgcttgagcgacagccagatcaccgaccacagcgcgaccgacggcgcgaacatcgagaggaacagcacgctcaggtgttcgtaccattcacgccagatcgccgacgtgcgatacgagcacgtcacgtagacgggatagctgccgacctggcgatacgcgacgatctcgctgctcgcgccgtcgtggcgcacccgcacgacaccggcgcgcggatcgttgcgtgcgtcgccgaacgtgacggcgcggtcggtgtgcgcgagtgccggcggcggcggatacgacgcgatcaccgcgccgtccgagcgcgcgagcgccatcgtcatcggcgtgctggcgccgccgagcaggtcgcggtagaacgcgttgaaatacgacgacttcagcgcgatcgacaccattccggcgaacgaaccgtcgctatggcgacgcgcgacgcccgtgttgaacacgggaatgttctcgagcttgagcggccccatcatcagccgcgagatgtgttcgatcaccttgccgtcgcgaatgccggcgaaatcgtcgcggttcgcgatcgacgcatagggcgccggatagtagaggctgttcgcgagcagcatcccgctcgcgccgaagatcgacacggccgccacctgcggatagccgccgccgatcgtgttcagcgcttcgtggatgtcggactccctgttgcgcacggtcgcatcgtccatgtcctgcacgagatcgacgatgcgcgcatcgagcgtctcgctcaggtcgaacaccttgagcgcgtgctcctcggcaacccgcacggtgcgcatcgtcacgtcgctcgcggcggcctcgcgcgtcttcaggtcgttgtacgccatcaccacgacgtagatgcagggcagcacgatcgccgcgacgagcagcacgatcagcgtcacgcgtcgcaccgcgaaatcgtgctcgggcgcaccggacgcatagttgccgtcgtcctgccagtcgtcggcgggcgtggaggcgggagcgtgggaatcggcgggccggtcggacgtcatcgaggaagcgggtgaggcgaaggtgcctgccatcataaacgagttgcgacggcccgccgaacggccccggatgcacccggacgcaagtaatcctgtcgatttcgacaggggaattcgtcagattgaaaacgcgacgaatccggcagcgcaaacgtacacaaggaaaaattttgcgtgcttatctcgaaaatggtcgcggctgttttcggaatggcgcatgttcggaccgattctgtccgaaatggtgaatatggcgagttgcatcgcctccggtttactccgagaatcgcgccttgctttccctatgacagatatctgcgcccgccggcactcgccgcgcggcgcgtcgcgcgcgcccgcgttgcggcgcccgcgcgcggttgcaaggcggctgcctgcgcccgaacgcatcggcgcctcaagaagtgcgccgcgcggtcgttaacgcgagagaccattccgtataccgcttcgccccatgcctttgccgattgtaattgccgacgattcgctgctcgctcgcaaacttctgacaaaggcgctgccgggaggctgggacgtcgatgtcgcgtatgccgcgaatggtcgagaggccttggcgctgtatcgtgacggcaaagcttccgtaatgtttctggacctgacgatgcccgacatgagcggatatcaggtgctggagacactgcgccacgaagatctgaacacgttcgtgatcgtggtatccgccgatatccagccgcaggcgcaagcacgcgtgcgcgaattgggcgcgatcgcattcgttgccaagcccgtgacgtcggaggcattgctgcccattctcaaggagtatgggttgtatgcctgactcggtgttcacggcggagcaacgcgacgcgttgcaggagatcgccaacctcgcaatgggccgtgccgccgcacggctcgcgttgttgctcgggcgcttcatcgaactgtcggtgccgcgcgtgcgggtcgtgaaagcgaccgacgcgggcgatgcgctgcgcgagatgacgggcatctacgacaacgtgaccgccgtgcgccagggcttccgttccgacatcaagggcgaggcgatcgtgctgtgccgtaccgcgagcatcgcgcggctcatgtcggtcgtcgaccgcacgttcggcgaaggcgtgtacggcgggatggcgacacccgacgaagtcgtgttcgacgtcgcgaacgtgctgatgggcgcctgcgtcgcatcgatcctcgacgagctcgggcgcaagcccgtgttctttccgccggggctgctcggcgcgaacgtgtcgttcgacgacgtcttccagccgaccgagctggcatggagcgtggcattgctgctcgaggtgaacttcgggctcgaggaccacgcgttccgggctcacttcgtgatgctgatggccgaggattcgatccggctgatgggcgacgcgctcgacgcgttgctgtccgcgctatgacggccgctaccccgtcgctgagcgatctcgtgatcgagcgggtgggcttcggcctgttcgtgctcgaccgcgcgatgaccgtgctgatgtggaatcgcttcatgcaggaccacagcggtatcccggccgccgacgtgatcggccgcaacctgttcgactgttttcccgacctgccgcgcgcgtggctgtcgcgcaagctcgagagcgtgttccagctcggcagctttgcgttcagctcgtgggagcagcggccctacctgttccgcttcgagcacgaccggccgatcacgggcggcgtcgactacatgcagcaggactgcacgttcatgccgctcacgcgcggccgcgacgtcgaggccgtgtgcgtgacgatctcggacgtcacgcacgtgagcgtgatgcagcgtgagcgcgaggaagcggtcgcgaagctgcgcgaacacgcgaatcgagacggcctgaccggcatcgcgaaccggcgcttcttcgaggcgcggctcggcgacgaattcgcgcgctggcagcgctacggcggcgacatgtcggtgctgctgttcgacctcgaccacttcaagacgatcaacgaccgtttcgggcatgcggccggcgacgccgtgctgcgcgagacggcgcgccgcgtcgcgtcgatcgtgcgtgcgcaggatacgttcggccgcttcggtggcgaggaattcgcgctgctgctgccgtgcacgaatctcgacgaggcgatgctcgtggccgacaaggtgcgcgatgcgatcggcagcgtgccggtcgatgccgagggcgtcagcgtgccggtgacggcgagtgtcggcggcgcgtgtgcaaaggcgggtgcgcccacttgcgacgtgctcgtcaacgaggccgacgccgcgctctatcgcgcgaagcggctcgggcgcgaccgctcggtggcctacgcgtaggcgcacccgcacggccctgctgcgcggagcggatgcgccccgcgcgtgccgtgctcagcttttcgcgatgtcggccagcacgccggccaggacggccggctgcgacatgaacggcgaatggctgctgtcgagctggtgcacgtgggtcgggttgccgggcgcgaacgcgtcggcttcgtcgatgaagcgctgctgcagcgcgggcaggatcacgcgatcctgcaggcacttgatgtagtggcggtcgatcgcgccccagcgcgcggccgtcgtcgggatcgcggtcgcgaacggcgcggccggcacgtcgcaggtcatcaggttcgcgacggcttcgaagtcggcttgcggcacgtcgtcgtacagcgcgcgcttcgcgagctcgcgatatgcggtatcaccgctgcgcggatcgatgcgcagcgcaccggcgacgcgcgggctcgccagcatcagcgggccgagcatctcacccttgttctcgggcgcgcgcacgtagtcgaggcccggcacgcccgacgcgggcatgaaggccgagagatagacgatcttcgcgattttcccgggcgcgcgttcggcagccgccgtgatcgcgaggccgcccatgctgtgcccgacgagcacgaccttgccgtggccgagcgcgtacgcgtcgtcgaccgcctgcatgacctgcgtcgcgtaatcgtcgagcgtcgtgttcgcgaccggcgacggctcggcgccgaacgcatccttgtcgagcgggcgggagaagtaggaagccggaaagcgggcgttgatgccgtgcgccggcaggtcgcgcgcgatcgacaggtggccgcgttcggccagcgcggccgcaacgtgcgcatagcaccacgcgccgtgccaggcgccgtgcacgagcacgaaaacgggatgatcggactgcggggtggcgcttgcgttcgtctccatggtgtccgggtcttcagattttgagaaaggtgtcatcttagacgaacccgcgcgcacccagacgggccgctttcgatctgtccctttgtctcgtacaggccacatttcgtccgtatccgatatgaatttatcccgaagcgcgctaatttgttgttttgcccgcgattgcgccccatgaacgtcgactatctcttctatcggaagccgaacaaacccggcccctattcgctcgacgacctgggcgacatcgcgccgccgatcggtccgggcgacctgatacgcgcgggcatcgcgcgtgttttcgcgcagatcgactggcaggaatcgcccgacgtgccgggtgcgtggttcggcacgggcggcgcggtgttccagttcaccgcggagcccgacggccacgtgacgagcttcatgggctcgcgcctcgagcgtcgctcgatgttgcagctcacgcgcgaaatggggctcattgcgctcgacctgcagcgcgacatcgtctacggctgacgcagcgccggcgccgcttcctgcccgggccgggcgcccttgccggccaacggcctccggcatgccgccgcatgcggcgagtgtccgccatcgaacttcaaagattgctatactttcgcccaattccggcttccggccggtaatttgtgcctgtctgcgtcgatcgttcgcatatctcgcacgcatttgacgccctgaccatcccagccgggcatggcttcttcaatcgccccgcgtgggtgtctccgtggagcttgtcttggccgtttccaattccgtcgtggacgaacaagaaaccgacgccgctgccgtcacatcgggcagttctttctatcttgcgatgcgcatcctgccggccgtgcagcgcgatgcgatgttccaggtctatgcgttttgccgcgcggtcgacgacatcgccgacagcgacctgccgcgcgccgagcgcaatgcgggcctcgatcgctggcgcgccgacatcgacgcatgctacgccggccgcccgccgcgccatctcgccgcgctcgaccgcgagatccgtgcattcaacctgcagcgcgacgatttccacgcgatgatcgacgggatggcgatggacgcggtcgaagacatctgcgcgcccgacgagccgacgctcgacctcttctgcgatcgcgtggcgagcgcggccggccgtctgtcggtgaggattttcgggatgcctgaagcccaagggatcaagctgtcgcatcacctcggccgcgcgctgcaactgaccaacatcctgcgcgacatcgacgacgatgcggcgatcaaccgctgctacctgccgcgcgagctgctcgcgcgcgaaggcatcgcgattaccgacccggcgacgatcgtgcgcgatcgtgcgctgccgcgcgtgtgcgcgacgctcgtcgagcgcgcgctcgagcatttccgccaggccgacgcggtgatggatacgtgcccgcgtgcgcaggtgaaggcgccgcgcatcatgtcgggggcgtatcgctgcattctcgaagcggcgatcgcacgcggcttcgcctacccgcgcgcgccgctgcgcaagccgaaggcgcgcatgctgatgatcgccgcgcgctacgcgctgttctgagtcgaccgagtcgatgcccaggaccgtccacgtgatcggcgccggccttgccggcctgtcggccgcggtcgagctgcaacgccgcgggcggcgcatcgtgctgcacgacgcgcacgcgcatgcgggcggccgctgccgctcatggttcgacgggacgctgaacacgacgctcgacagcgggctgcacacggtgttcgcgggacagcccgcgacgcagcgctacctgcgtgtgatcggcgcggccgaccggctcgcggggcccgcgctgcctgaattcccggtcgtcgacgtcgcgtcgcagcagcgctggacgctgcgcttcggcgacgggcgctggccgtcgtggctgttcgatgccgcgtcgcgtgcgccgggcacgacgccgctcgactacctcgcgctcgccccgctcgcgttcgcgcgcatgggccgctcactcgcacagacgatgcgatgcgacggcatgctgtgggaacgttggctgcggccgtatttcctcggtgtgctgaacgtcgagccgcgccatgcgagcgccgaacttgcgcgtgcggcgctgtgcggcacgtttgccgcgggcggccccggctgccgtccgctcgtcgcgcgcgatggtctcggcagcgcattcgtcgaaccggcgctgcggatgctgcagcacggcggcgcgcagatccggctgaactcgcggctcgacgcgctcgaattcggcgcgcacggcaatgcggtcgatgcgatctcggtcggcggcgagcggatcgatctcgcaccgggcgatgccgtcgtgctggccgtgccgcccgaggtcgcgcagccgctcgtgcccgagctcaccgcgcccgacacgttcagcgcggtcgtgaccgcgtacttcgcgatcgaggcgccggccggcacgccgttgcagacggcggtcgtgaacggtgtcgtcgatgcggtgcgcaccggcggcggccagctcgcggcgacgatccgcgacgccggccgctggctcgacacgccgcgcgacacgcttgcgcggcgcatctgggaggacgtcgcgcgcgtgacgggcgcgaaccggaaaccatccccgcgtggcagctcgtcgtcgagccgcgcgcgggctttgcggcggtgccgtcgcaggaaatgaagcgtccggccgtgcgtacgcgctggaccaatctcgtgctggcgggcgactggattgccaccggcttgcccgccacgatcgagggcgcgatccgctccggccagctggccgcggacgtgctccagacacagtaagcaacagagggaccgatgaacgatctcaccgaaatggctaccttgtccgccggcaccgtgccggccggcgtcgatgcggccgtcgcgcgtgcgaccgacgcgctgctggccgcgcagaacgcggacggccactgggtctacgaactcgaagccgattcgacgattcccgccgaatacgtgctgctcgtccattatctcggcgagacgccgaacgtcgagctcgaacagaagatcggcaagtatctgcgccgcatccagcaggccgacggcggctggccgctgttcaccgacggcgcgcccaacatcagcgcgagcgtgaaggcgtatttcgcgctgaaggtgatcggcgacgacgagaacgccgagcacatgcagcgtgcgcgccgcgcgatccacgcgatgggcggcgccgagatgtcgaacgtgttcacgcgcatccagctcgcgctgtacggcgcgattccgtggcgcgcggtgccgatgatgccggtcgagatcatgctgctgccgcagtggttcccgttccacctgtcgaaggtgtcgtactgggcgcgcaccgtgatcgtgccgctgctcgtgctgaacgcgaagcgcccgctcgcgaagaacccgcgcggcgtgcgcatcgacgagctgttcatcgatccgcccgtcaacgccggcctgctgccgcgccagggtcaccagagccccggctggttcgcgttcttccgcgtggtcgaccatgcgctgcgcgcggctgacggcctgttcccgaactacacgcgcgaacgcgcgatccgccaggccgtctcgttcgtcgacgagcgcctgaacggcgaggacggcctcggcgcgatctatccggcgatggccaacgcggtgatgatgtacgacgtgctcggctacgcggaagatcatccgaaccgcgcgatcgcacgcaagtcgatcgagaagctgctcgtcgtgcacgacgacgaagcgtattgccagccgtgcctgtcgccggtgtgggacacgtcgctcgccgcacatgcgctgctcgagacgggcgacgcgcgtgccgaggaagccgtgctgcgcggcctcgaatggctgcgcccgctgcagatcctcgacgtgcgcggcgactggatctcgcgccgcccgcacgtgcggcccggcggctgggctttccagtacgcgaacgcgtactacccggacgtcgacgatacggcggtggtcgcggtggcgatggatcgcgcgcagaaactccggcagaacgacgcgtatcgcgattcgatcgcacgcgcgcgcgagtgggtcgtcgggatgcagagcagcgacggcggctggggcgcgttcgaaccggaaaacacgcagtactacctgaacaacatcccgttctcggatcacggcgcgctgctcgatccgccgacggccgacgtgtcgggccgctgcctgtcgatgctggcgcagctcggcgagacgccgctgaacagcgagccggcgcgccgcgcgctcgactacatgctcaaggagcaggaaccagacggcagctggtacggccgctggggatgaactacgtgtacggtacgtggacggcactgtgctcgctgaacgcggccggcctgacgccggacgatccgcgcatgaagcgcggcgcgcagtggctgctgtcgatccagaacaaggacggcggctggggcgaggacggcgacagctacaagctgaactatcgcggcttcgaacaggcgccgagcacggcgtcgcagacggcctgggcgctgctcggcctgatggcggccggcgaggtgaacaacccggcggtggcgcgcggtgtcgactacctgatcgccaaccagaacgaagaaggcctgtgggacgaggcgcgcttcacggcgacgggcttcccgcgcgtgttctacctgcgctaccacggctatcgcaagttcttcccgctgtgggcgctcgcgcgctatcgcaacctgaagcgcgacaacacgacgcgcgtcacgttcgggctgtaacgcgtggcgatgcaatccaccggcatgctgcccgtcatcgccgtgacggggatggcgttcgaggcgcgcattgcgcgcggcgacggcgtcgaagcggtcttcgccgcgcgcgccgaccggctcgaacgcgcgctgaccgaggcgaccgcgcgcggttgcgcgggcatcgtgagcttcggcaccgcgggcgggctcgcgcccgacctggcgcccggcgcgctcgtgatcgcgaacgcgatcgacgggccgttcggccgcgtcgagaccgatacgcgctggagcacgcggctcgtcgccgcgctgcacgacacgccggtgtgggcgcgcgtcacacgcggcacgatcgcggccgtgggcgcaccggtcgtcagcgaacaggaaaagacgtcgctgcatcgcgcgaagggcgcgcttgccgtcgacatggagtcgcatatcgcggcggccttcgcggcggcgcgcggtgtgccgttcgcggtgtgccgcgcgatcgtcgatccggcgtggcgcacgttgcccagcgcggcgacggccggcctgcgcgacgacggcagcacggcgatcctgccgatcctgcgtgagctgctgaagcagccgtcgcagctcggcccgctgctgcaggtggccagcgacgcgcgcgcgcgcacgacgctgatccaggcgcggcacgcattcgagcgtgcgggcgcgatgcggatcgtctgagcggcgttcgccgcttttcttacccctcccttcccggctttccttccggttctcgcggacaaatcgcggacaaaaaagagcgctgcagatttgaactgcagcgctctttttcttgcggcggtaaccgttgcagcgttactgcgcggccggactgctcgcaggcgttgccggcgcggttgccgatgccgcggcaggcgcagcagccggcgtgctcgccggcatcgcaccgtccgcacccggatcgtcgtactgcggcagccccggcgcggccggtgcattgttcggcgcagcgcccggtgtaccgcccgactcgcccggatcctcgtagttcggcaaccccggcacggcaggcgtcgcggccggcacggcgcccgattcacccggttcgttgtaggtcggcagcgtcgcggacgacgactggctgcgatacgtcagcgacttgcgctgctgcaggtacgcgtcgcgcacgaacgaatacggatcgagcgcggcctgcttcagcaggtcggtcgcgccgagcaggtccgagcgcgcgctgatgaactgcgcgatgtacatcgggttgcgcgcggccggctcgatgtagttgagcaggttgaaacgcacgtccaccgcgcggccgatgccgtcgcggaacgtgctcggcccgaacacgggcagcacgaggtacgggcccgacggcacgccccagcgcgccatcgtcaggccgaaatcctggtgatgcttcggcagcccggccggcgtcgcgatgtcgatcaggccggcgacgccgaacagcgagttcatcgcgacgcgcatcaagtcctgcgtcgcgtcggtgatgcgcaactgcagcaggttgttcgcgatgttgccgaggtcgccgaggttcgagaagaagttgctgatcgcggtgcgcacgggcgtcggcgtgaccttctggtaacccttcgcgatcggctgggcgatgttcgtgtcgacggtgtcgttgaacttgtacatcgcccggttcatcggctcgagcgggtcgttggggttgcggttcggtcccgtcgcgcagccggtcagcactgcgctggcggcaacggtcgccgcaatgattcgcaccttattcattgattccttgcgattggttcttggcgcgtttgacgcgcggtttgcccatcaggacgggctggaacaccacggcgccgatcagcgtgcaggtcagggccagcgcgagcagcttgcccatgctcgacgtgcccgggtggtgcgacagccacaggctgccgaatgcggtcgccgtcgtcgcggcgctgaacaggacggcgtgcgtgaggctcgagtgcagcagcccggtttgcccccgcgccacgccatcacgaaatacaccttgaacgcgacgccgacgccgagcatcagcggcagcgcgatgatgttcgcgaagttgagcgacatgccgagcacgacgcacagttcgagcgtcacgatgcccgacacgagcagcggcaccagcgtgcgcagcacgtcgccgaagcggcgcagcgtgacccacagcaggatcgtgatcgagatgatcgaccacagtgccgcatgcaggaacgcgttgatgatcgtgtcggccgaatgcaggatcgagatcggcccgccggtcgcgcccggctccgcagccttcacggtcttcgcgaagcggcgcagcatcgtgtcgtcgttcgggtcgacgcccttcggcaccttcggcgaaatctgcacgagtgcgtggccgtccggtgcgacccagtcgcgcacgagctgcggcggcagcgattcgcgcgtgatgtcctgcggctgcagcagcgaggcgagctggttgagcgcgatgcgcagcgtgtcggagaacgcacgctcggcgcggtcgcgcgtcgcggcgtccgcggcggcgagtttcgcgagcgaggccgacaggtgctgcgcggcggccgcgcccgggcccgggtgatcttcggccgcgtagctcagcaggtccgacacgcgcttgagcgcggcgacgcgctgcgcatcggtcgcgggcggcgcggccggctgcgtcagcgcgggcagcaagtcgctcgcggccgcggcgatcgccgcgcgcttggccggctggtcggcggggatgaaggtcgacagtgtggtcgtgcggccgacttcaggcagtgcgtcgaggcgcttcgcggccgcgtcggcatcggcgagcgacggcgcgagcagcgtgacgtcgttgacggcggcttccggcgaatccttcagcgcgagcagtgtcgccatcgattcgctgtgcgggtccttcaggtgcagcgggttgaagtcgaagtggaggaacgcgagcagcggcagcgcgccgatcacgaccacgagcgtgccgatcaggattggcttgcgatggcgatcgaggtagtcgtcgaccggcgcgagccacgggaagcccggcgtcttcgattcgcccggcggcgcgaacaggcgcagcagcgccggcagcagcgtgatcgtggtcagcagcgcgacgaacatcccgacgcccgcgatcaggccgagttcggacacgccgcgataggcggtgggaatgaacgagaagaagctcgccgcgacggccgcggtggccagcgcgagcggcatgcccatcgagtgcgcggcgccgatcagcgcgtgatcgatgcgcggatcgcggaagcgctcctcgcggtatttcacgccgtactggatcgagaaatcgacgccgaggccgacgaacagcaccatgaacgcgaccgagatcatgttcagcgagccgaccatcgcgaggccgagcgcggcggtcacgacgaggccgacgaacagcgtgacgagcaccgagccgatcatccgcttcgagcgcagcgccagccacaggatgacgagcacggcgagcagcgtgagcgcgccgttgagcgccgcgccatcttcgacggacgcgaattcgtcgtcggcgagcggctgttcgccggtcaggcgcacggcggcgccgtagcgcttctcgaggtcgagcgaacgggccgcgtcgcggatcacctggctggtttccgcgccggccttcagcgcgccgtagttgaccaccggctgcacggtgacgaacgcgcgcgcgggctgccgcgcggcatcgttgtcgaccagcgcgcgccacgagaacgcggccggcttgccggccagcacgtcgtcgaccgtcgcggcgctgcgtgcgagcagcttcgccatcgcgggcagtttcacctggccggtcaggagcggctggccgagcgtggtggagagtgtggtcgcgaggccggtcaggctcgggttcttcgcgagttcgttgacgagcgggcgcgcgctcgcgagctgcgaggtggtatccgtgacctcctgcggcgacaggaacagcagcccgttgtgctcgaagaacggcccgccgccgggctcggccacctggccgatgcggccggcgtcggcatccttgcgcagcgcttcggtcagcgcatgcgcggcggcgttcgcgaattcgggcgccggcgcctcgacgaccgcgaggatcgtgccgttgcgttgcgggaacgccttgtcgacggcctggccgagggcggcccattgcggctcggcatcgacgagcttgctgatgtcggtgttgatcttgaaatgctgcgcgacatagacgccgctgagcgcggcgatgacgagcgacaggacgacgacccagacggggcggcgcaccgaccatgcaacgagtcggacgatgagagatgtcaccatgtggcggtggggagcggctggcaagggcaaagtagccaagtataccggcgcggcgtggcggcggtcgtgacgttgggggttcggggcgggaaggagatttgttcgcgacggtggaatcgatgccgatggctcgccggtttgtaagggatatttacataatcggcgccgcgccgcgccgcgccgcgccgcgccgcgccgcgctgcgtcgtcgcgccgccgcacgcctgtgacaaaggaacctgaaaggtaacagtcggtcacggcggcgcaccgaggcgtcgggcccggtatactttgcttcgtcggccggtgcaatgaaccggtcgtttttctcatcgagcgatattcgtatgaaacgtcatctgtttgctttcgtcgcggcggccgccgtgtcggtttccgcttttgcgcagagcgcgccggtcgatatcgtccgcaatgcggtcgaaggtaccgtcaacgcgatgaaggccgatccggccgcacgcggcggggacatggcgaaggtctcggcggtcgtcgagcagcgcttcctgcccgcgaccaacttcgagcgcacgacccgcatcgcggtcggcgacgcgtggaagcaggccacgccgcaacagcagcaggagctttacaagcagttcaagctgctgatgacgcgcacctacgccgcgtcgctcgcgcagctcggcagccaggacgcgaagttctcgttcaaggccggcggcgcgtcgggcgccgacgcgctcgtgcagtcgaccgtcacgacgccgggcgacagccagtcagtcggctatcgtctcggcaaggtcggcaacgactggaagatctacgacatcgacatgtcgggcgcgtggctgatccaggtctaccagggccagttcaagagccagctcgcatcgggcgggatcgacggcctgatcgcgtatctgcagaaacacaattcgcggacgaactgacggctgctgcgcggttcggaatccggatgcatgaagggcgccctcgggcgcccttgtttatttaccctggggcgtggtgggcagtcgaacgaccgacgcgtccgcacgtccgggcgtgcccgcgcaagtccaggccgcctccgcgcacatcgaggttcgctgtgcgcgacttactgatacgtcatggtgaaggtcagcacggcgtttgcgctgccggctgtgaccttcgcggccgtctggtagtacctggcggtgagcgggatcgtgtaggagccgccggtcgatttgctgtagctcgtcagcgtgtactgcgtgttgtatttcagcgcgttgccgttgccgtccttcagttgcaggccgataccggtggccgtcgaaccgctcgacagcgccagcacgccgttggtgctgtcgaggacggcattgaccgggatgaactggtactggatcgagttcaggcctgtcgggcaggcgttgaccgccacgttgagcgagacggcctgcttgttggtcgagccgatgcccgtgaattccgactgcatgggcgagcccatgttgaccgtcacgttcggcgtggtgcacgccgcgacgttgacgatggtcgaggtcagcgaatacgacacgtggctcgaagcggagaccgcaaacgggccgttgatgtttgctccccgtcgagggcgctccctcgaacagcacgccgcccgtcaccgtgcccgccgtgatggcgccggtcttgaccagcgccacctgaacctggccgccgttggtgaccaaactgttcgtaccgttttggttacaggcccacccagcccaagggctgggtagcggcggcctcggcgtgccgagatcgtcccatggctgccatccacaaccgttcgcataggaacgcacgccgatcgcgacaccgacgcccggcacattggtattccagaccgtataggccacaccattcggcccggccaccgtcatgccggccttggtcatcgacagcgcttcgaaggccatacccgagaatgcagaacccgacacgaggcaactatagaagttggtggtggccggagtactggcccaggtcgtcagcaccgtaccgatcgctgcgtcgcgcgggatcgtcaccgaagccggcatcgagatcgtcaccgtctgtgccgtgcccgtgcaactggcgctctgcgcgagcgcggcacgcgaacccggaccaagcatcaacgctaccagcgcgagcagccagaacaccatgcggccccagccgcgcgccgacttcgcctgccggcgcgtcgcggtcgaattttcgtttcgtttcatgatctctcccaggctcatttcatcagcagcgctcatttcgtacataccgcttccgtatcggtccaccgttgccggctcgtgttgctcgccggcgcaagcgtgtaggacagcgaacaaccctcggcggccgtgtcgccccacttcaccttcagcgtgccggtatccgtcttcacgccgcgcagcacgacgcggccatcctgcgcgacggtgccgacgttctgccccgccgtatcgctcacctccgcgccgaacggaaccggctcaccatcggccatgcgcgcgcgcatgattaccgcgcgtccgccgccctcggtctcgtacttcagccgcaccaccgcacccgcggtcggcgcgacgtgctgtgcgctggatttgagctcgacgctcatcggcacgcccttcggatcgatttccacctcgttggtcgagaacggcgtcagggtcgacaccagtgcatgaccgaaccgatcgatgcgcaggccgctgccggacgtcacgcgtgcgccgtttgcgtccttggcctcgacgatcgccatcgtctcgcccatggtcggcgtgaaggccacgccgccggcataggccaccataccgcccgagatgccgccgccgtactgcgtaaagccggtgcccttcgaagcgttgcccgacaaggtcgcatacggcgacatgtaggacacgttgccgccgacgttggcggtcgccccgtgccgctgccgcgggtatggccgacgttcacgccatagctgagcgcgttgtcgatgccgagcgagccggtcagcgactgctggaccagggttgcgccatgactgtcgtgttgcaggctggtcgacgagtacaacgtgcgcgagccgaagttcagcgggatcgacacgttcagcatgaagcggttgtcccagcggttttgcgtcgcgtcgaattggcgcgcgactgacacgccgtagttgatgcgccggaaattgttgctgtagccggcctggaactgcgtgtcgttgccgctgcgattccagtaattgacggtcgagccggacaggtagaacgagccccagccttccggcaggccctggttcagcatgacctggaactgaccgcggcgcacgccgcccgacagcaggccgttcacgccgccggtctgctggctgcgcaactgcatggcgtcctgcaggcccaggtaaccgctgctcgaataacgataggcggccaccgcgatattggtattggtcggactgatcagcttgctgtacgagagcttcacgctctggccgtggcgcgtgcccaggccgggcagatcggtgttggcctgcgtgatgtccagcgcgaacgagcccagcccggtgttgagcgcgacgccggccaggcctgccaggtagccgggcgcggccgtcatgccgccgtagccggtgatcaggttggtgaaaccgtgctgtacggtcgcctggaacagcgcgggcttgctcgacagcagcggactgcggtactggccggccgtcacgctgaaacgcgtgatgccgggccgcagcgaactgacggccgacgcatacggcaccttgaaggtgtggatgctgccgtcggcttcggtcacgatgacgtcgaggtcgccgccataaccggtcgcatagagatcgtcgatctcgaacgggccggtcgcgacggtggcgctgtagatgatgttgccgttctggcgcacctgcaccagcgcattgctgttggcgatgccgtggatggtcggcgcatagccgcgttgcgattccggatacatgcgctcgtcgctggcgatccgcacgccgcgaaagcccacgctgtcgaacatcgtgccgtcggtgaacgcgtcgccgatcacgagttgcgccttcaggcgcgcgatcgagcgctgcaggctggtctgcacgctttggtagtgtgtgccgccgtgcgtgtcgtaggtggtgttgccgttgtggcggaagcgccagggcccgacgttcaggccggcggtcaggcccaggtaggcctgggtcgacgaggcgccctggttgtcggcgcggtagatgttgccgttgtacgacagcagcgcagccggcacgccctcgtcccagtagcgcggatccacgtagccgcgcgccgcgcggctcaacgaggcctgcgggatgctgacgtcgagccgctgctcgccattgtcgaaagtggcgacggcgtccggcaccagcatgccgatcgtcgcgcaggcatggttcgagtccgtcaacatgagcgtcgcttcgggcgacagcttcgcgagatccaccccgacctgctgcagcagctcgcgatcgaagcagggctggacgttgtttcggctgtcgcccacctggcgcagcgtgatcgcggtacgaccgatccagttcgtgttgacgtacaggtcggcgcgatacgaacccggcgccgcggcattgcctttttcgaagcgactgacgtccacccgcgtgccgcccgggcgctgcaggaacaggtcgtcgaactggacttccgccacctgtgtggcgcttgtggtctgcgccatcgtgccagtcgacgcgaacaccgacagcgcgagcaggaagcacgggcgcgggcgccagcgcacgaatggcggcaaactcgaaagacgttggatcacgataggcacccgagcgtgagcaagcctccgccctgcccgggcgggcatgcttggtcttgctgtggaaaggacgtggcgcgctacccgcgcctcgcgcaatggaagagagtcagtcgcgcatcatcgcgacggtgcggcggtgtctgaccgcaatggcgtctcgccgatgaccgagccgccgtagtcgttcagcgtcgtgtaacgcacgctggcgccggccgagccgggcacatcgcctttcagcgggaaggcgcgcgtctcgcccggcccgaccatgccgccatcgtcgaagattgcgctgcgtccgcccgactgcacgctgatcgtggtcagcgacacatggaacggcgtcgggttgtgcgcctcgatggccggcttgccgtcggcctgtgtgagccgccaggtgagctgcgccggcgcgtcggccgatgaacccgcgagtttttccggacgatagaacagcttgatgcgcgaacggaatgcgagctggatacggttcatgtccgcgtccgccgcgctcggcttgggcggaacctcgagcacgttgagccagaacaccgactcgtgatcctgcggcatgggctcgccggtgtagacgatgcgcagcgtctgcgatttggacggatcgatccgcgagatcggcggcgtgacggtgaagggcaccttggtcgtggacggcgcgccgcgcacgtcacctgtatcgacccacgactgcacgagcgcgggcgactggccggcgttcgacagcttgagcgtgacctcggattcgctcgcggcatagattacgcgcgtgccaccgatcaccaccgatgcatcggcgggcgttgccaggtagccgagccatgcggcgcatgcggtggcgatcgcgcgccggagggtgtttcgaagcttcatgatggagatcgatgcaggtagcgagcacgagggacggagcgacgtcgtgtcgctccgcccgatcttgctatgtataactaagtgattggttactgataaacgagcgagtacatcacgctcgacgtcgccgcgcctgccgttgcagcgccggttgcgaagtactgcgcgtagtagttcagcgtggcggtgccggtcgagctgattgcgactgacttcgagttttgcgaggcgtcagctgcgccgatcttgataggcgaataggtgccgtcgccgttcagcagctggatctcgacgttggtcgcgccgccggcggccaggatcaggttgccggtggcggtgtcgaccgtcgggcccggttcgaagtaggtgtggacgttgcccgacgccggcgtgcaggccgtcagcgcgatgttgaagggcgtgcggttggcccactggcctgcggcggccagcgcgctggtcgccaccgattgcagcggcacattgaagttgttcgagccgctgccgttgccgttgatcgtgcaggtttgcgcggtaacgctgccgttgaacgtgattgtgccgtcggctgcggatgcgatttgcgacgcagtggctgcagccacgaacaacacggcggtaatgagtttggtttgcatgttttggtttcagaaagaatcgatctggatggtgatacgacgccgacgcgatatccgttgacagcgcgacgcgacatccaacggcgacccgaaaaggcatcacacggccgaatattatgttttcggcttggttacacttggacagaacgaatcctactggcgtcaacaattcgtaagatgaacaattgtcactttgcggtggcaccaatgaaaaatgccgttcagcgtgactgaacggcattcgccttcgggtgcctggtgcgttgccgtgcgtcaggtgccggcgccgagcatccgcaggcaatcgtcgaccaccgcgtcgacgaacgcggtgcgatccgtttccggcgccgcgatgatgtggtcggtcgcgccgtgcacgcccgcgtagatcagcagcgcggtgacctgcgggtgcgcgagccgccaggtgccggcccgtgcgccgccgtcgagaatctcgccgagctgttcgaggatcgcattcttgtcggcattcgcgcgatcgtggtgatggtgattcgcgtagacgatgtcgtgcgtgcggtaggtcgccgcgtaggtttcgatgttggtgcggatccacgcgcgcaggcgcgcgagccagtcgtcggcgtcgcacgcgtccacggcgtgctgcaaacggtcgaggaacgacgccgtgtagcgctgcgcgagcgcggcgagcatgtcggatttcgattcgaagtagtggtagaacgtgcccttcgccacctgcgcgtgctcgacgatctcgctgatggtcgtcgcttccacgccctgcgcgaggaacagcctttcggccgcggccatcagctcctcgaggcgcacttccgccggcttcgtgcgcggcagcttgcccgccggcgcgtcgtcctttcctgtcgtgattcctgcctttgtcctgtccgtcatcgcgcggctcgacgcccgttcgtgcaaagcccgcagtttaggccagcgccccgttcacggccaacgcaatccattgaccgacggtcagtcggtatatatgatgcgaatcattctcatcttcgtgcccgtgaagggccgactgccatgcctcgctaccgtcgcgccgcactcgtcctggccgcctgtctcggcacctttctcgccacgctcgacatcagcatcgtcaacgtcgcgttgccgacgctgcagacggcgctcgataccgacatcggcggccttcagtgggtcgtcaacgcgtacgcgctcgcgctgtcggcgttcatgctgtcggccggcccgctcggcgatcgctacgggcacaagcgcgtgtggctcgccagcgtggtcctgttcacggccgggtcggtggtttgcgcatgcgcgagccggctcgagccgctgctgatcgggcgcgcgatccaggggctcgctggcgcgttgctgataccgggcgcgatgccgatcctcacgcatgcgtttcccgatgcgcgcgagcgtgcccgcgcgatcggcggatggtccgcgttcagcgcactcgcgctgatcctcgggccgctggcgggggcctgctcgtcgagcatggcggatggcaggacatcttcctcgtcaacgtgccgatcggcatcgtgaccgtgctgctcggcgcgtggggcattccggagcgccggcatccgcagcacgcggcgttcgatccgctcggccaggcgctgagcgtggtctggctcgggttgctcacctacgggctgatcggcatcggcgaagccggcgcgtcgcacgtgaaggtgctcgtgccgctcgcgggcgccgcggtggcgttcgtcgtgttcgtgcgtgtcgaaacgcgcgtcgagcggccgctgctgccggtctggctgtttcgcgaccggcggctggtgcgcgccaatctcgcgtcgttcgtgctcgggttctcggggtacagcagcctgttcttcctgtcgctgttcctgcagcaggcgcaggggcgcacgcccgccgccgccggctggcaactgatgccgcagttcgtgatgacggcggtcacgtcgatgctgttcgggcgcatcgcggcgcgcattccgttgcacgggctgatggtggccgggtacggtctggtcggcgcgatgctcgcggtcatggcgggcttcggtgcgggaacgccgtatgtgccggtcggcatcgcgctggcggtgctcggggtcggcatggggctcgcggtgcccgcgaccggcatgaccgtgatggaactcgcgccggccgaacgcgcgggcatggcgtcggcgacgatgaacgcgttgcgccagacggggatgagcatgggcatcgcggtgctcggcagcatgatgagcgtcggtgcgctgcaccggatgacggccgcgatgcaagcggccggcagcgcgcaagcggatacgctggcgcggcaggcggtgatggagcatgtgtttgcagcgggacagccggcgctgcttggcgcgtatcgggatgcgatggcgcacgggttttcgatcgcggtcctgtgttccggaatcctcagtgtgggtgttgcggtgatgctgatgatgcggcgtgaaacgaagaagcaatcggggcgcgcggtggcggcgtgtatgacgtcttcacagccggattgatatgccttgccggccggccgagccctttgcagcagatcgcggcaccgacctaccttcgccgatgctcgaccgcgaacttgatcagctcggcctgccctcgatctccagcttgcgcttcaggttgagccggtgcgtctcgaccgtgcgcaccgacagccccgtctgctgcgcgatctgcttgctcgacagcccttcagccagcgcgtcgaggatgtcgcgttcgcgcggcgtgagccggtcgagcggcgacgcggtcgtgctcgcgtggatcatccgcgcggcgagcccttcgctgaagaacgtctggcccgccagcaccgtgccgatcgcgcgcacgatctcgctcgcgggcgaatccttcagcaggtagccgctcgcgccggcgcgcacggcctgcgtcacgtattcgacgttgtcgtgcatcgacagcatcagcacgcggatgcccggaaagcgttcgtgaaacacgcccgcgagcgtgatgccgttcatgccgttcatgccgatgtccatcagcgcgagatcgggttcgagcgacgcggcgagcgcgagcgcctcgtcggcgttgccggcttcgccgaccacggacaggtcggccgcttcgagccgcatccgcaagccgtcgcgcacgagcgggtgatcgtcgacgagcagcagtcgggcgacgggccgggcggtgtcgggggcgctcatgcgtgaaaggtctcctgtgatggggcgcgtcatgacgcggcgccgggcagcggcacgcgcgcggcgacgatcgtgtggccgacctgcgacgtgatcgtcagcgtgccgccgagcgcgtcgaggcgctcgcgcatgttgcgcaggccgatgccgtggcgcacgtcggcctgcgagcgttcggcgtcgaagccgcagccgttgtcggcgatggtcagcgtgacggattgcgcgccgacgtcgagcgtgacggccgcgcgcgacgcccgcgcatgatgcacgatgttgctcaacgcttcctgcgcgatccggaacagcgcggtgttgaccgccgcgggcagcggccgggcgccgctgtgcgcgacctgcgtgtaaccgatgtcgatgccgctttcggcgccgagctcgcgcaccagctgctcgagcgcagccgcgaggccgagatcgtcgagcatcgcggggcgcagcgcatgcgagatgcgccgcacttcacgcagcgtgtcgccgagccgcacgacgcccgatgtcagcgcctgctcggcctcgggcatgcgcgcggtaccgcgttcgaagcgcgcgagcgcggattcgagcatcagcttcgccgataccatcatctggctgatcccgtcatgcagctcgcgtgacagccgcgcccgctcctgttcctgcgattcgacgacgcgctgcgcgagcagcttgagcttcgcgtcggcactgcgcgactcgctgacgttcagcaccagcgcgcacacggcgatcgcggccgcccccgtgagcgcgattgcggtgagccagctcatcgtgcgctcgatgttcgcggacgcgcgcgcgtcgatgcgctgcagcgcggtgtcgacatcgtcgagatagatgccggtgccgaccatccagccccagcgttcgagcgcgatgacgtagcccagcttcggcgcgacgcggcccgtcgacggccgctgccacgcgtagcgcacgtagccgccgccgctcgacgccgcgccgatcagcttctggatcgtcagcgcgccctgcgggtcgcgcatcgaccagtagttgtggccgacacgctcgggctcgcgcggatgcatcagggagttgccgtgcaggtcgtacacgaagaagtaaccgtccgggccgaaatccatcttctgcagcatcgcgagcgcctgcgtgcgcagcagcgcgtcgtcgcgcgcgttgcggccgctcgcgtcgtagagcggcatgatcgcgctcgtcgcgagctcgacgtagtgcttgagctcgacctccttgctcgacatgtacgcggcctggatcgtcgcgtgctgcgtgcgcgcgagggacgtcgcctgctggcgcacgccgaaaccgatgccggcgatcgcgagcaggaacggcacgatggccagaaggaagatctttgccttgagtctcatggtggtgcgaagcggccgcgcacccgcgcgggccggccgggccaggcagccgcgcggcggcgtgtcgaggcgacattgtcggcgattttgcgcgcgggcggcgacagtggccggcagccgccctgccgtcgtccggcggcggcccgttcaggcccgccgcgccgcgaggccgccggagggccgcgtgcacgacgatgcggttgcgcccgccttccttcgcgcgatacagcgcgtcgtcggccagtttcagcgcggcctgcatgtcgtcgtcgtgttccggatagctcgtcgtcacgccgatgctcaccgtcaggcggccggtcgccccggcgtcgtgccggatgccgagatcgaggatgccggtgcggatcgtctcggcgatcgacgccgcgccgtccgtgtcgacgtcgggcagcacgacgacgaactcctcgccgccgtagcgcgccgcgtaatcggccgggcggcgcaggcagccggcgatgcagtggccgaccgcggcgagcgcgtcgtcgccggcctggtgcccttgggtgtcgttgtagcgcttgaagtagtcgacgtcgatgaacagcagcgacagcgcgtgctgcgagcgcgcggcccggcgccattcgcgtgcgagcgtgacgtcgagcatgcggcggttgtcgaggcccgtgaggccgtcggtgcgcgcgagcgcctgcagttcggtttccgcgcggtggcgcttgcgcagttgcacgtcgagcagcagcgacaggccgacgaagccgatcgcgagcgcgaccatcgccgagccgatcggaatcgcacggtcgtaccacgcggcgtaggtatccgcttccgagcgcgcgaccatgatgatgagcggcaggtgttcgagatgccggaacacgtacaggcggcgcacgccgtcgatcgacgcggtatcggcgaagctgccttcgttggcggtcatgaaccgccggaacgtgctggcgtggctgatgtcgcggccgacgatcttcgggtcgtacggctcgcgcgcgaccatcttgccgtcggtgttgatcagcgcgatcgagccgcgatcgccgagcgacagccgcgagaacaggttctggaaatattcgagccggatcgacatcacggcgacgccgccgaacgagccgtcgggctccgtgatccgccggctgagcgcgatgctcggcgagccgccgcgcaagcgcgaatgatacgggggctgacgtacaggccgacgtcgggatggtcgcggtgcaccgcgaagtacggctcgttgccgaagttggccttgcgcggcacatcgctcttgccgtcgaccgcgatgtcgcccttcgcgtcgagcacgtagatgccgccgaggtacttggccgtcgtcgcacggtcgaacagcacctggcggcgcagcggcatcggcagcttgacgacatccgggtcgttctcgccttcgacgacggcctgcagcgacagtgaatagatttcgatgttgcgctcgatgtcccacgacgccatcagcgcgagattctgctgcatcgagatcgagcggtcgcgcgcgtcgatgcggccttcgtacagcacgatcccgcacagggacagcaggagcagcgcgatcagcagcccggtatagaagatcaggtgcggcagcaggaaccggcgcagatgtgcggcgacacggctcgtcaggccggattcgctgggcactgcgtaatcggtttctgccatggtccgtggatcgatgggcattgccgccgggcggcgggccgatgcgattgttcgtatgacgtggcggcggcgatccgccacgcgtccattcgacgccttcttgccggccggcgagaaaatggacactgattaccgggaatcgcggccagatataccggtaaatcgagcatttactggtgacatctacgccgattcaacgatccgaggaatcgggcagtgcgaattcaacggagtataacgcgcgcgttcgcgcgcgcggaaaatgttgcgggccgttgatccggatcaaatttcagtgaattcccgggcttgcgaatatccggcaaagcgttccagcgcaaggctgtacggcatgagcggcgaaaccgcggcgcgcggccgccgattcccatcgggttaacggcaggcgagcgaaaaatgaaggcgtcgatatgcgccgattattcgtttcagcagccgggcgaacgtgaaaatgaaaacgggcggccgttgcggccgcccgtttcgtgaagcccggcgtacgggcttccggcgtacgggcttccggcacgccggaaacccgcggcacggccgtgcttatccgccgtgctgttgcgccttgaacgcgagccggaaccggtgcagcagcggctcggtataaccgctcggctgcgacgtgccctgcagcgcgagcgcgcacgcggccttgaacgcggtcgactggtcgtagccgggcgccatcgggcgatagttcgggtcgccggcgttctgctggtcgacgacgcgcgccatccgcttgaacacgtcgagcacgaatgcctcggtgatcacgccgtggcgcagccagttcgcgatgtgctggctcgagatgcgcagcgtcgcgcggtcttccatcaggccgacgtcgtggatgtcgggcaccttcgagcagccgacgccctgttcgacccagcgcacgacgtagccgaggatgccctgcgcgttgttctcgacttcgctcaggatctcggcttcgctccaagcggcgcgctcgacgaccggcacggtcagcagcccttcgagcagcgtgtcgcgttcgctcgcgtacggcgtcttctcgagttcctgctggacggcctgcacgtcgacgaggtggtagtgcagcgcgtgcagcgtcgcggcggtcggcgacggcacccacgcggtgttcgcgccggcgcgcggatgcgcgatcttctgctcgagcatcgcgtgcatcaggtcgggcatcgcccacatgcccttgccgatctgcgcgcggccgcgcaggccggccgacaggcccgcgagcacgttgttgcgctcgtacgactggatccacgccgacgacttcatgtcgcccttgcggatcatcgggcccgcttccatcgcggtgtgcatctcgtcgccggtgcggtcgaggaagccggtgttgatgaacgcgacgcgtgcggcggcggcggcgatacacgcggcgaggttcacgctggtgcggcgctcctcgtccatgatgcccatcttcagcgtgttgcgcggcaggttgtacagatcctcgatgcgcgcgaacagcgtatcggcgaatgcgacttcgaccgggccgtgcatcttcggcttcacgatgtagatcgagccggtgcgcgagttgcgcttcgccttcaggtcgtgcagcgagcacagcaccgtgacgacgccgtcgaggatcccttccggaatctcgttgccgtcgcggtcgagcaccgcgccgttggtcatcaggtggccgacgttgcgcacgaacagcagcgagcggccgtgcagcgacagcgtgccgccgtcgggcgtcgtgtactcgcggtcggcgttcaggcggcgcgtgaaggtcttgccgcccttcgcgacttcctcgaccagcgtgccctgcatcaggccgagccagttgcggtagagctggaccttgtcgtcggcgtccaccgccgcgaccgaatcctcgcagtcgatgatcgtgctgaccgcggcttcgagcacgacgtccttcacgttcgcgagatcggcgcggccgatcggcgtcgatgcgtcgatctggatctcgaggtgcaggccgttgtgcttcagcaggatcgcggacggcgcgtcggccgcgccctggtagccgacgaactgcgccggctgcgcgaggcccacgatccccttggcggtttcgacggcgagctggccgtcctgcacgcggtagcgcagcgcgtcgcggtgcgagccgctcgcgagcggcgccgcgttgtcgagcacgttgcgcgcgtagtcgatcacgcgctggccgcgcgtcgggttgtaggccgtggtgcgttcggcgccgccgtcttcaggcagtgcgtcggtgccgtacagcgcgtcgtacaggctgccccagcgggcgttcgcggcgttcagcgcataacgcgcgttcgacagcggcacgacgagctgcgggccggcctgcgtcgcgatctcgctgtcgacgttcgcggtggctgccgcgacgttcgacgggaccggcacgaggtagccgatttgttcgaggaatgcgcgatacgcggcgtggtcgcgcaccgggccggggtgcgcgcggtgccaggtgtcgagttcctgctgcaggcggtcgcgttccgcgagcagctcgcggttgcgcggcgccaggtcgtgcaccagggccgagaaaccgctccagaacgcggccttgtcgatgccggtgcccggcaacgcttcgttttcaatgaactggctcagcgctggcgcgacttgcagtcctgcttggtcgatcatcgttaatcctcccgggaaaaatcgcgcgcggcttggctggtcataccgcgacgctttgtgtgccggcgcgggcaatctgcgcgtcctgttcggactttacgccagacacgccgatcgcgcccgcgatccggccgccgaccgtgaccggcacgccgccttcgagcaaccccgtcagcggcgcgctgagaaacgcggtgcggccgccgttgatcatatcctcatacgccttcgtctcgcgccggccgagcgccgccgcgcgcgccttgtcctgcgcgatacaggcgctggccggcgatgcgccgtccaggcgtgcaaacgcgagcaggtggccgccgtcgtcgacgacggcgatcgacacggcccagccgtggcgttccgcttccgcgcgggcggcggcgagcatgcggtcggcatcggccagttcgagttcgggtttcgtctgcatggagatcctccggaatcaggtcagttgacgagtcggttgtcgacgagctcgatccagtggcgcacgggcgtgcggcccgcgccgttcaggtgagtctggcagcctacgttggccgtgacaatcaggtccgggcgcgcggcttcgagcgcatcgagcttgttgtcgcgcagcgtcgtcgcgagttcgggctgcgtcagcgaatacgtgccggccgagccgcagcacagatggccgtcggcgacattcgtcagatcgaagccgagccgcgtcaggatgctttccaccgcgccgccgagcgctgcgcgtgctgcagcgtgcacgggcagtgaaccgcgacgcggcgcggcgtcgactcggccagcgcgtcgagcggctcggccgcgatcacttccgcgaggtcgcgcgcgagcgcgctgacgcgccgcgctttctccgcgtagacggggtcggagcgcagcaggtcgccgtattccttcacgaacgcgccgcagccgcttgccgtcagcacgatcgcttccgcgcccgcttcgatcgcgggccaccatgcgtcgatgttgcggcgtgcgcgggcgaggccggcatcctgcgcgttcaggtgatattcggtcgcgccgcagcagccggcctcgcgcgccgggctcacgctgatgccgagccggtcgagcacgcgcgcggcggccgcattggtgttcggcgacagcgacggctgcacgcagccctcgagcatcagcacgcgccgcgcgtggcgcacgggcgggcgcggcgcggccgcgggcacggcggccgggatcttgtcccgcagcgtgccgggcagcagcgggcgcagcgcgcggccggccttcagcaacgcggcgaacgtcgccgggcgcggcacgacgtgccgcagccccgcgcgcagcaggcgctcgcgcgcgggccgctgcgcacgcttttcggcttccgcgcggccgatgtcgagcagcgtgtgatagcgcacgccggacgggcaggtcgtctcgcagttgcggcacgtcaggcagcggtcgagatgccgctgcgtgcgttcgccgcacggctcgccttcgagcagctgcttgatcaggtagatgcgcccgcgcggcccgtcgagctcgttgccgagcacctggtaggtcgggcaggtcgcattgcagaagccgcagtgcacgcacgcgcgcaggatcgcttccgcttcgtcggcccgggcgagggccttgcttgcttcgctgagattggtttgcatcggcgggtcgggatcgggttcgcgtcagaaatcggcgtacaggcggccgggattgaaaatcgcgtgcgggtcgagctgcgccttgagctggcggtgcacgcgcagcagcgcgggcggcagcggctggaacggctcgcgcgtcgtgcccggcgtgaagcaggtcgcgtgcccgccccattgcgcggcgagccgctgcacgtcggccggtgcggcgtcgctcttcagccagcgctgtgcgccgccccagtcggccagcagcgcgccgggcagggcgtcgagcggcgcggcggccggcaccgacacgcgccacagcgggcgcgggtcgtcgaagaacggcagcgcaaggtcgcgcagccgtgcccagaacgcatcgtcatggtcgtccatgcagtcgccgccgatcgtgtcgcgcgcggccttcaccgagccctcgccgccttcgatccgcacgcgcagcacgccgtccgcgtggcaggcgcccgcgagcggcagccccgtgcgccgccatgcggcgacgcgctgcacggcttcgtccaccgcgagcggcaacgcgagatcgcacgtcgcacggggcttcggcagcaccttcagcgacacctcggtcacgacgccgagacagccgaagctgcccgcgagcaaccgcgacacgtcgtagcccgcgacgttcttcatcacctcgccgccgaagcgcaggtgtttcgcgtggccggtgatcacgcggcagccgagcacgaagtcgcgtaccgcgccggcccacgggcggcgcgggcccgacagcgccgccgcgaccatgccgccgaccgtggccgcgccgccgaacgacggcggctcgcacggcagcatctggccggccgaatcgagcatcgcttcgaggtcggcgagcggcgtgcccgcgcgcgcggtgacgacgagttcggtcgggtcataggacacgacgccgcgatgcgtgcgcacgtcgagcgtgcggccttcgactgggcgcccgaggaacgccttggtgccggcgccgcgaatgtgcagcggctggcggtcgtggatcgccgcgtcgacctgggcgacgagcgccgcgctgtcgtcgatcgattcgatttcgcgtcgcatcagaaacgctccagttcgggaaacggcagcttgccgtgatggacgtgcatcgcgccgaattcggcgcagcggtgcagcgtcgggatgttcttgccgggattgagcaggccctgcggatcgaacgcggccttcaccgcgtggaagaacgtgatttcgtcggcgttgaactgcacgcacatctggttgatcttctcgcgcccgacgccgtgctcgccggtgatgctgccgcccgccgcgacgcacagctcgaggatctttccacccagcgcttccgcgcggtcgagttcgccggggcggttcgcgtcgaacaggatcagcgggtgcatgttgccgtcgcccgcgtggaacacgttcgcgaccggcagcccgtattcggcggacagcgcggcgattccttcgagaacgcgcggcagctcgcggcgcgggatcgtgccgtccatgcagtagtagtcgggcgacatgcggccgaccgcggggaacgcgttcttgcgaccggcccagaagcgttggcgctccgcctcgtcgcgcgcgacacggatctccgatgcaccggcatcgcgcagcagcgtcgcgacgcgttcggcatcttcgtcgacgtcggcgggcgagccgtcgagttcgcacagcaggatcgcctgtgcgtcgaccggatagcccgcgtggatgaaatcctcggccgcgcggatcgcgaggttgtccatcatctcgaggccgccggggatcacgcccgcgccgatgatccgcgcgacggcggcaccggcttcggcgacgtcgtcgaagctcgccatcagcaccttcacgctcggcggcttcggcagcagcttcacggtcacttcggtgacgatgccgagcatcccttccgagccggtgaacaatgcgagcaggtcgaagccgggtgcgtcgagcgcgtcggtgccgagcgtcagcgtatcgccgtcgatcgtcaggatctcgaccttcaggatgttgtgcaccgtgagcccgtatttcaggcagtgcacgccgcccgcgttttcggcgacgttgccgccgatcgagcacgcgatctgcgacgacggatcgggcgcgtagtagaggccgtgcggcgcggctgcctgcgagatcgcgaggttgcgcacgccgggctgcacgcgcgcgacgccggcatcggggtcgatgtcgagaatccggttgaacttcgccatcacgagcaggaggcccttttcgagcggcatcgcgccgcccgacagcccggttcccgcgccgcgcgcgaccaccggcacgccgagcgcggcggcgacgcgcagcaccgcgcgcacctgctcgaccgtgtcgggcagcacgaccgcgagcggtaccgtgcgataggcggcgaggccgtcgcattcgaacggcttgagcgcttcgcgctcgtgcagcacgtcgaggccgggcgccgccgcgtgcagtgcggcgacgagtgtgtcgcggccgacggtcgccagcgggccgtcgatccgttcgtcgtaggtgaaactcatcgtgtgtctccgtctccactctcttcgccatgcgggcggccgcgggatacgcgccgcgccggatggacggcattcttggcggccggccggtgtgtgtccatacgtcgcgggcgtggtcataccagtttttcgaggcgtgccgtgaagccggggtcggtcttgatgtaaaagccaatcacgacaagggtttatgagaaaatcggcgacatccgtccaaagtggtcataccagtatggaaatgcaggatcgacaagcgccggcgcgcaatgtcgccgatgtcgtcgccgagcggatcgagcaattgatcgtcgacggcgtgctgaaggccgggcaggcgttgccgtccgaacggcggctgaccgagaagctcggcgtgtcgcgcacggccgtgcgcgaagggatgaagttgctgcgtgcgcgcgggatcatcgagacgacgcacggcaagggctcgttcgtcgcgagcctgaccccgcagcgcgaagtctcgccgatgatgcacctgctcggctcgcagccgcgcacgctgtacgacctgttcgaagtgcgcgggatgctcgagacggaggccgcgcggctggcggcgctgcgcggaacgtccgccgatttcatcctgatcaagcgtcgctacgacgagatgaccgcggccgatgcgcaggatctcgacccggccgcgcgcgcgaagctcgatcacgcgtttcatctcgcgatttgcgaggcgtcgcataacccggtgctcgtgaatacgttgcagtcgctgacggatctgctgctgagctcggtgtttgcgtcggtgaacaacctctatcaccgcgagccgttgaagaagcagatcgatcgccagcatgcgcggctctataacgcggtgaccgggcggctgcccgagcaggcgcgcaaggcggcgagcgagcatatccgccagtgcgtcgaatatctgagggagatcgagcaggaggagcagcggctcgtgcggtcgacgttgcggcttgaagggtggacttgagcaggcgccggtgtgttcgtgccatgacgtccatcaagcgaagtgcgtcgacgatgcggtttgattggttattgcatcatgatgcgatgtatctggcacgaggcacgccctgatttgcacgttcgtgcaacacgcgccgtgtaccgtcgcacgtattacgccatcgatcctgacaggaggatgctgcatgtcgatgccgacgcatgacggcgggcccgacgcccgcgccgacctgactccgcatgaagaccgcgctgcgctgctggcgacgctcgacgagttgctggaggccgagcgcgcggtcgcgcgtgtcgcttccgaaatggtcgtcgaggtgagcgacgatcctgaactgcatcggctgatcgcccatattcgccaggatgacgcgcactggtgcagcgtgctcgtcgatgcgatccggtcgctcgatgcggaaccgacgcgcgcgaccggcgtgttctacgagaaggcgatggcgatcgacgatctggcggagcggatggcgttcctgaatcgtggccagcgctgggtggtccgcaagctgcagacgctgcttccgacgctcgccgatcgggacatgcatcacgcactgtcgttgatgctggtggcgcacgagaagaatatcggggcggtcgatgtgcggctgcgcggcggagcggacggggcgcaacctgcgccgtaatcgccaggattgcggtttcagcccggaatacgtccatgtcatttgcctcgcttggcctgatcgagcctctgctgcgtcatctgcaggacctcgattaccagacacctgaaacggtgggggccgaggcgattcctgtggtgccgagtggcgagtacgtcatggccgcggccgaaaacggcacgggcaaaacggcgggttttgcgctgccgctgctgcaacgcctcgtccgacacggcccggcggcgtcgagcaaccgcgcgcgtgctggcgcctgcgcgtgaaccggccgaacaagaactgcgaagcttcgtcgagtccggcaaggccctcgaagaaacgggctccgactgcgattgcgcggcaacggtgcttgtaccgagacggactgggcccgcccattcgcggccatcgcgtaataatcgatactatccggcaggtagcggcattctctgtcgatcatcgccgccgccggatgccacgtacgctgcttgacccacgcgctgaataattacaaccgacccatgaatcgatcgcttctatccgttgtctcggcaatgttgttgatttcggtcccgatgaccgaggtattggctagcgagcccggcaaaacggcaaccaccgacccctcgctcgtatcggcgacggtcgattcaacaagcgcgcaacagacagctgtcacgctcgctcaacgtgggcaggcagcagaaaaggcccgaaattacccgctagccatcagctattacaccgcggcactcaacttgcatccgcttcttcttgacgcgctggtagggagaagtcttgcatacgacaagatccacgagcgggaaacttccgcggatgatgccttggctgcggcgaaaataataagcgacgagggaaaaattataggcttgcgtcctatctttacaggttcgcgggtcttggatactccttgtcgaacaagtatgaaaaatccgtagtcgcctttacggggcaattaatattgatccatcggatccgggcgcctatgtacacagggcgggttcttataaattaatgctggatttcgatcatgctctcctggacctgaaaaaggcgttggagctcgaccctgggagcatcgacgcaaaagacagttatgcaatggctttcgcggatatggggttgtatcaggtcgccatcgacaaattgaacgagtcgctggccgcggataaaaatgcgtcgacgacctacgtgaatctcggccagtgtatatgtcgatgggaaggtatgacgactcccgccgaaatttgaacaaggcgctgcaactcgatccgcgagattgggatgctgtcttgaaagacgtaaagctgaatttctatacaaagaattatgcggccgcattgcgtggagccaatgcatggctggacaacaacagggaaaacagcagttccgaagatgttgcatacatgctgatctggaagcatctggcatcgcaacggcacggcgtggatgatcgggtgagcctggacggcgaatcttcgagcttgcggaatcaggaatcctggcctcgcccgatcatcgattacttcctgtcgaaaatagatgccgaccaactcaggtggcagcggccaagggtgatgacgggcctcctgggacgcggcaatgtgaagccgagacttatatcggggaagcgaatatgatggccggcaagatggaggatgcaacgagaaatttcgaaacggctgtttcgctatgtccggtttcgtgggctgaatatgatttggcgaaattcgaaatacaatcgataaagaatttcgtcgcgtcaccgtaattaaagccgggatggggtgtgagtcaccgaaggccgcatttgctgttgggcgcttgcgcagtcaccaggtgaccgtcgtcgtgaaacctggcggtcgcttgcagatcgtttggcgacatccatcccgatccgcgaagataaaaagcccgccgaagcgggcaacctctcgatgcggagggggagatacgaatacgcagggctgcgcgcgttcagcctttggtcgccccgaacgtcagccccgccacaaaatgcttctgcatcgcgaagaacatcgcgacggacggtaacgccgccaggatcgacccggccgacacgaggttccacgacgtcgtccattgccccttcaacgcggcaacccctgccgtgatcggcgcagcctcatcccttgcgtgagacacagcgcccagaagtagtcattccacacgaacgtaaaaacgagaatcgccagcgcagccagcgccggccggatcaacggcaacacgatccgccagaacaccgtccattccccgccccttcgatccgagccgcctcgatcagctcgaacggcagctgcttgatgaagttgcgcaggaacagcgtgcagaaccccgtctggaacgcgacatgaaacaggatcagcgcctcgaccgtgttgaacacaccgagccgcagcgacaagtcccgcaccggaatcatcagcacctgcaccggcacgaaattacccgcgacgaacgtgccgaacagcgccgtgctcccgcgaaacttgtaggtcgcaagcgcaaagcccgccatcgccgcgagcgcgatcgagccaagcacggacggcaccgtgatctgcacgctgttccagaagtaatgcagcatcggcgacgtggtcagcgcatcgcgatagttctcgatcatcgagaagtgccgcggccagccccagtagtggccttcgacgagttcctcggtcgagcgcaccgacgtgacgaacaccgcgatcatcggcagcagccagatcacgagcgcgacgggcagcgacagcttgtacagccggcgcgataccggcttccattgggcaacgggtgtcggaaacatgatgaaggcatccctgaaggtcgggtcactgctcgttgcgcagcaggcggcgcaactggaacacgatgtagacgagcatgatcgcgaacagcacgaccgcgatcgacgcggaatagccgagccggtagtacttgatcgcctggtcgtacatgtaatacgcaagcacggtcgagctctcgaacgggccgccgctcgtcatcaccgagatcaggtcgaagctgcgcagcgcaccgatcaccgtgacgacgatcgccatgaaggtggtcggccgcagttgcggcagtaccacgtgccacagcagcgcgaagccgcgcgcgccttccatgcgtgcggcttcgatctgttccggattgagcgacgtgaggccggtgaggtacaggatcatgcagtacgcggtttggggccacagcgcggcgaacacgatgccgaacgtcgcgtagcgtgcgtccccgagcaccgggatgccgtgtccggcgatcagcgcgagcagcccgaacgtcggatcgtagaaccacgagaagatcaggccgacgaccacacccgacagcacgaacggcgcgaagaacagcgacttcacgagccggatgccggcgaccgcctggttcaggtacagcgcgagcgcgaggccgagcggcggcgcgagcatgaagagcgcgagccagatcacgttgttgcgcagcgccgtgtagaacgccggcgcttgcagcagctccgcgtagttcgcgagaccgacgaacgtgcgctcggtcatcccgtcccagttgtacaggctcagccacagcgtcgacaggatcggccagatcacatagacggcaaccatcgcgcaggccggcgcgagaaacagccacgcggcgcgccgttgccgccgcacggcgggcgacgggcggcgcgcgggtagtgcatcagcggcaaccgctgcgggcgcgcgaggtacgacggttccggcggcgcggcgggcggctcgaggtgtcgggacgaaatcggactggacacggcagggctcctgaacgagcgaacgatgggacagccgcagcgacggagcaccgccgcgcgggtcacggcgttacttcttgtagatccgcttgcgggtctgttcgagctgcgcgagcaccgtatcgagctgcgccggattcgcgaggaattgctgcatccccttcatcccctcgtcggccatttccttcgtcatgtcgcggtcgtagaactgcgcgacgccgcccttcgtgtcggcaaggatccggaagccgatgcgcgagaccggatcggccggctcgggcgacttgctgttggccgacagcgaaccgaggccttccgcgagcttcgcgcccatctcggtgtttcgacgaacgcgaggaacgtgtgcgcgtcggccttgttcttcgccttcgtcgggatatgcagcgattcgaccgggccatcctcggcggtcggcaccttcgggtcgatgatcgggaaacggtagtagcccatttcctgcttcacgttcggcggaaaacccgccgcgatgaaggtgcccatcagcatcatcgcggccttgccctggaacaggaacggctgggcgccgtcgagatcgtaggacagcgcgttgtcgatgaagtagccggcgtcgatcagcgacttccacatcgtgtagaccttcttcacgcgcgggtcggtgtacggcacgtcgcccgccatcagctgctggtggaacgcgttgccgttcaggcgcaggtcgagatagtcgaaccagccggcgagcgtccacgcgtcgcggccgccgatcgcgaccggcgtgatgccggccgccttcagcttcttgcacgcgtcgagaaactggtcccacgtcttcggctcgtcggcgatgccgaccttgcggaacaggtccttgcggtagaacagcccccacgagtagtagacggtcggtgccgcgtactgcttgccgttgtacgacgatgcgtcgcgcgtcgatgcatacatcgcgccccagccgttcttcgcccagtcgccgctcaggtcctcgaacagcccgcgcttcgcgtagtacgccatccgctcgccggcgtgccagttcacgacgtccggcgcgacggtcgtgagccaggcgggaagctgcaccttgtacgcttcctcgtcgacgaaggtcgccttcacgtcgatgtcgggatgcgccttgtggaacgcgtcgagcgtcgactgccagaccgcgcgctggctggcgcccttgaacgcgatgttgatcgtcagcgtgccggcatcggcgggcgccgtcgtgccgagcgatgccagtgcgacggcggcggccgtggcgagccgggcggcgaggcgaaggggcgatgtgtcatgcgtgtctccattcctgtgtgtcgtcttgtgcgtgaccggcgcatcgcggcgccggtgtcggggtgctacgaacggcttcgatacgcggccacgtcttgcggcccgacttgcgcactgccgagcacgaacgccgacggcggtaccgcgtcgatcgtgtgcggcgtgtcgccatagttgaaaacgtaggtcaggccgccgcgccggctcacgcgcgcgccgtcgccgagcggcgtcggcgtgaggccggcttcggccgcgacatcggcgaacagccgggcggtggtcgcgtcgtcgaacagggcggcccagtagtgcagcgtgccgtgcgacacgcaggccgggtgaccgtcggcgaagcgcgcgcgcacgacgccgcgcgtgtcgtcgtgaagctcgacgaagtcgcgccagtggcgcgcatggcccgcgagcggcgtaccgtcgtacagcgtgccgtcgatcggctcggtcacgttcggccgcagcgattcgacgcgccatacgcgcaccggcaggatcgatgcgagcgggccgggcggcagcgtcggcggaatctgcaggtcgacggtcttcgagccggtgcgcggcccgaacacggcgtgcgcgcccgaggccgcgagccgcgcggcgaaatcgtccgggacgaccggcagcggcggcacgacgacgagccggtagccgtcgagcggcgcatgcgcggaaacgatgtcgacgtcgaggccgagcgaacgcagcgccgcgtagtactcgaacgcgaagcgcgggtagtggaaatcggcgccttgcggctgcacttcgaacagccacttcgcttcgtagtcgaacacgagcgcgacgggggcacgcaccgcgccgttcgggtcggcatcggcacctgcgtcgcgtacggccgcgatctcgcgcgcgacgcgctgcgcctcgcggccgccttcgtcgagccggttgtccggcgtattgagacccgcatgcatctgctcctgcgcgaacggcgcctgacgccagcggaagtacgacacgcaaccggcgccgtgcgcgaacgcctcccagctccacaggcgcaccatccccggcagcggcgcggggttccactgcgcccagttcacggggcccggctgctgctccatcacccagaacggcagcttcgacatgccgcgatagaggtcgtgattgaacgacgcgaaatcgggatggccggtgcgcagccagcgcgccttcacgtcgggcgcgaaccattgctcctcgagcgcgccgagcggatagctgtcccaggtcgcgacgtcgaggtcgcgcgccacttcgtaatggtcgaactcggtgaacagctgcatgaagttgtgcgcgacgggccggcccggcgagtgcgcgcggatcacgtcgatctgcatccggtgatagcgcgcgacttcgtccgacgcgaagcgccggtagtcgaggcgatgcgacgggtgcgcttcggtcacggtgccgacgggcgcatcgacctcgtcgaaatggcgatactccatgctccagaacacggttccccacgcgcggttcagcgcgtcgatcgtgccgtagcgcgccttcagccacgcacggaagcgcacgagcgcggccggcgaatagctgacgacggtctggtggcagcccagctcgttgtcggtctgccagtagcgcacggccgggtgccggccgtagcgctcggcgaccgccgtgcagatctggcgcgacgcctcgagataggtcggcgacgagaagtcgtagtggcggcgcgagccgaacgcgcgcggccggccgtcggcgccgatcgcgaggatgtccggatggcggtcgaccagccatttcggtggcgtcgcggtcggcgtgcacatcacgatctcgaggccggccgcaccgagcacgtcgaccgcgcgatcgagccagccccagtcgtattcgcccggcgacggctcgatacggctccacgcgaattcggcgatccgcacctgctcgatgccgagcgctttcatcctgcgggcatcgtcggcccacatcgattccggccagtgttccgggtagtaacagactccgaggcgcatgcccgatccttatgcgtagtggtgaacgtggacgtcggcgcacgcgggcaccgcgcggccgtcttcggtgaagagatggcaggccgcggccggcgcatgcacgagcacgcgttcgccgctgcgcacctgcgcgtcgccgggcaccttcgcgatcagcgagtggccgccgggctggtcgaggtgcacgtaggtctgttcgcccaggcgttcgacgagcgcgacgtcgcgtgcgagtgtcgtggcgtcgtgcgcggcgccgagcgtcaggtgttcggggcgaatgccgagcgtcacggcggcgccggcgccgagcgccgagccgtcgcgcggcagcgtgaaggtttcgccggacggcgtgagcgtgacggtcgtgcgacgggcatcgcacgccgtgacgacggccggcaggaagttcatccgcggcgagccgatgaagcccgcgacgaagcggctggccgggtggtggtagaggtcgagcggcgccccgacctgcgcgatgctgccgtgctgcgcggtgtcggcgccggcgtgcagcagcacgatcttgtcggcgagcgtcatcgcttcggtctggtcgtgcgtcacgtagacgacgctcgcgcgttcgaactggcggtgcagccgcgcgatctcgatgcgggtctggccgcgcagcgcggcgtcgagattcgacagcggctcgtcgaacaggaacacgccgggctcgcgcacgatcgcgcggccgatcgcgacgcgctgccgctggccgcccgacagcgccttcggcttgcgctcgagcagcgtgtcgagctgcaggatgcgtgcggcatcgcgcactttccggtcgatctcggctttcggcacgcgtgcgagcttcagcccgaacgccatgttctcgtagaccgtcatgtgcggaaacagcgcgtagctctggaacaccatcgcgacgccgcgctcggcggccggcacgtcgtcgacgcggcggccgtcgatcgacaactcgcccgcgctcaggtcctcgagcccggcgatcatccgcagcaacgtcgacttcccgcatccggacggcccgaggaacacgcagaactcgtgcgcgccgatctccagatcgacgtcgcgaatgaccggtgcgtgatcgccgtaggctttctgcacgcgccgcatcgagatgctcgccattgtctccgctccatgttttaatgcgccatcgtcgttgattaagcgcttaatcatcgcgatcaaaaagaggcgatgcgatcgcggccgagtcgcacccgttggtcgggcggcagggtgtgcggcgatagtgcgccgcttcggtaagcgaagcaaatactggatagacgtctcatatagtgagcaatcgatggcaaccctggatgaagtggcgcgccgcgccggcgtgacggccgcgaccgtgtcgaacgtgctgcgcgagcgcggccgggtcggcgaggcgacgcgtgcgcgggtgctggaagccgtggaggcgctcgggtatcggccgcatctcgcggcgcgtgcgctggcggaagggcgcgcgccgacggtcgcgctgatggtgtcgagcatcgcgaacccgttctacccggagttcgcgctggcggtcgagcgcgcggtgcgccgcaacgggcagttcctgatcgtctgcaatacgaatgaagacccgctgcaggggcgcgtatctcgaccagattgccggcacgatctccgaagggattctcgtgaccaacgcgaacctgcatctgcccgatctgctcgacgtggcggcgcgcggtgtgccggtcgtgctgtgcctgtgggagcggccggaggcgccgcccgacggattgccgtgcgtggcgatcgattttcgggaggcggggcggatcgcgacgcggcacttgctcgagctgggccacgagcggatcggcgtgatcgtcggcgggtcggcgagcggcgtgcaggcggcgcgctacgacggcttcgtcgacgtgatgcgtgaagccgggctcgacgcgtcgatcgtcgcggcggaacccgattcgatcgaaggcggcgtgcgcgcggcggggcggctgctcgacgcgcatccgcggctgaccgcgctggtcgcgaccaacgacctgccggcgatcggggcgatgcatgcggcggccgatcgcggccggcgtgtgccggacgatctgtcgatcgtcgggatcaccgacattcacctggccagcgacacgcgccccacgctgacgaccgttgcgatcccgactgccgaggccgccgggctcgcggtcgaattgctcaatgcgctacgcgacgcgggcgagcgcagcagcgctgcgtcgcgcgtgcggatcgcgtcgctgccgaaactggtggtgcgcgggacgaccggccgcgcgtccggcggagcgcgacgcggtcgatttgacgtatcgatgtgttgaatgtcgcgatggagggtgccgccgcgatcggcgcgactcgacaaggcaggacaagaccggcccggcccgcgcgcggtgcagcaggcggcacacgcagcgccggtttcagtcgccttcgacgagccccatcacgatgcgcctggccgattcgagatgcgcgaccgtcatcgaccgagcggcacgcgcattgcgttcgcggcacgcctgcaggatctcttcgtgctcgacctggaacgacggcgtatcggcgagcagtgtgccctgcaggcgctcgtaccgttcgacctgactgcgcagctccgcgatcgtctgcaattgccgtgcgttgccgcagcacgaatacagcaacgcatggaattcgcggttcagttcgccctgccggcgcggcactgccgtatcgccgagcaggcgatggacgagttcggcacgcgcgagcgtctcgtcgtcgagccgcttcacgcttcggtagatcgcgtcgccttcgagcagcacgcgcaggtcgtagatttcctgcacgtccgatgcgcccagcatgcgcacgacggcgccgcgattcctgaagatgtccagcaacccttcgcgctccaggcgctggatcgcctcgcgcatcggaatccggctgatgccgaaccggtcggcgaggtcgcgctcgacgagccgttcgcccgcttcgaactcgccgttgatgatcatgtcgcgcaacgaggcggcgaccgcgtccgccgtggaatcgagtttggcttccatgcctgtgtgttccgtcaatttggaataatggtataccaaacgaaaatccggtgccaaaatggcgaacgcaggcgggctccgtacgacgaaatccggcccggtcgaagcaacccacatcaatggagagcgagatggcatctggtgaacacaagtatcgcgtcgcggtcgcgtggacgggcaatcgcggcaccggcacgtcggggtatcgcgaatacggccgcgatcacgtgatccgggccggttccaagccggacattcccggttcgtcggacccggcgtttcggggcgacgcgtcgcgctggaaccccgaagacctgctgctggcgtcggcatcggcgtgtcacaagctctggtacctgcacctgtgctccgaagcgggcattcgcgtgctcgcttatgtcgacgatgcggaaggcacgatggtcgaccgtgacgagccgggccgcttcacggaaatcgtgctgcgcccgcacgtgaccattcaggcgggcgatgatcgcgagcgggcggaacatctgcatcatgatgcgcacgcgaagtgctatatcgcgaactcggtcaattttccgatccgctgcgaacccacgatcgaatttgccgcagcgtgacgccgacacccgccggacgaaatcgacgatgaagcttttctactaccctggcaacgccagcatggcgccgcacttcgtgctcgaggaaatcggccagccgttcgagcttgaatacgtcgaccgcacgcacgatcgacacaagtcgccggactacctcgcgctcaatccgaacgggctcattccggtactgatcgacggcgatctcgtgctgtatgaaacctccgcgatctgcctgcctctcgccgatacgcatccggagcagcgtcttgcgcccgacctctgcacgccggaacgggctcagtagttaccgcagcgactcgtgcgcccggcgatccagctcgcgatgaaattcgattcaccgttgttccggagtgcgtacaggcggataaacgaaaggtccgcttgaaatcgatctggtctggccgacggattctttgagaaaccgattggggatgtccgattccacgtcaatcagacgagactgaaattcgaaatttgtgtttctccgtcaacagcttggcaatatttgacagtcattcttcgatgtttcagtaagctcgcgttcaataaccaaacgaacggacgcgggccgcgtcgaccagaatgaataagaatgcgcaccgcctggtgttttccaggcttcggggtatggtggtggccgtcgcggagacagcgacagctgaagggaaatccgcaacaggcgaagctcgcgcgcggcggcggtcgtcgacgtccggcgctcgcgttctggtggcgggcgtcgccgcgctcggcatgctacccaccctgtccgatgcgcagatcgtcccgacgcccggcaccagcacgcaggtgatccagacgccgaacggcttgccgcaagtcaacgtggcgcgtccttcgagcgcgggcgtatcggtcaacacctacaaccagttcgacgtacagaaggccggcgcgatcctgaacaactcggccacgatggttcagacccagcaggcgggctggatcaacggcaacccgaattacggcgccggacaagccgcgcggatcatcgtcaaccaggtcaacagcccgaatccctctcaaattcgcggcgccgtggagatcgcaggcgcccgcgcggaactcgtcctggctaacccgtccgggattttcgtggacggcggcaccttcctgaataccagtcgcgcgaccttgacgaccggcgtgccgtactacggcgccgatggttcactcgccggatacaacgtcaaccgcgggctcgtgaccgtctcgggcgctggcctgaacgcaaccggtaccgatcaggtggaccttatcgcccgcgctgtacaggtcaattccgccatctatgcgaagaacctgaacgtgatcgccggcgcggcccaggtcaatcacgacacgcttgccgcgacggcgatcgccggtgatggtcctgctccgtcggtcgctatcgacgtaagccaattgggggcatgtatagcgatcggatcgtcctcgcatcgaacgaattcggcgtggggtggccagcgccggtacgatcgccgcgcaggcaggcgacctgacgctgcagtcgaacggccggctcgtgctcacgggcaagactacggcaagcggcaatatggcgctgtcggccgcggacggcatccagaacagcggcacgacgtatgcgcagcagtcgttgtcggccagcacaagtgccgatctcacgaacagcggcacgctcgcagcgcagcaaaatacaacggtcaacgctggcagcgtcaactcggccggcacgctcggcgccggcgtgaacaacgacggttccgtcacgcacagcggcgacctgaacctgacggcgtcgggccagttgaccgcgaccggccagaatgtggcgggcggtaacgcgtcgctgacgggcggcagcgtgaatctcaccggtagccagacggcgacgaacggcaatctgtcgctgagcgcgacggccggcgacgtgaacctctcgaacgcgacgacgagcgcgcaaggcgccattcaggcgaatgcttccggcacggtgatcaacgatcacggcagcttgtcgagtggcggcagcacgacgctgaccggcggcaacctgtcgaaccaaggcggcaaggtctcgtcgcaaggcccgctgtcggtcaacgtggccggccagatcgccaaccggtctggcgagatggtgtccgaaagtacggcggaggtgcgtggtggcgccatcgcaaacaaccagggcaccgttcaaagcgcggccgggatgacggtggccggcgcgtcgctggacaacacggccggccggatcacgtcgcttaacggcgacggcctgtcggtgatgaccaccggtcaactgaccaatgcggcgggcacgaccgcgaacggcgcgcacggcggcgttatcggcggcaacggcgatgtgtcggtccaaggcgcaaacgttgtcaatcgcggcgtgatcacctccaatacgaatctgcgggtatcgggccagtcggtcgacaacggcagcggcacgctgcaggccgcgcaaaggtggttgtcgacgcaggcgtgcgcctggtcaacaacggcggctcgatcgtcggtctgacggccgcgctgacgggcacgaccctcgacaatagcgcgggtgccgtacaggccaaccaggtgtcgttgaatgcgaccgacctcgtgaaccatggcggcacgatcacgcagacgggcgctggcgcgatggccgtgaacgtgtcgggcacgttcgacaactcgaatgccggcacgctgcaaaccaacagcaccgacctggcgctcacccccaccgcactcgtgaatgacggcggcacgatcacgcatgccggcaacggcacactgacgctcggaggcggctcgggctcgatatcgaacgtaggcggttcgatcgcgagcaacggacgcgtcgccgcccaaaccggcgcgctaaacaacgcggcgggctcgatcaacgcgcagagcggactgacggcaaccgttgccggcacgctgaacaatgcgagcggcaagctgttgtcgaatacggatctgagcgtcaccagtggcatgctgacgaacgatggcggccagatcggtgcgggcacgaacgcggcaatccactcaggctcgatgacgaaccagaacggttcgatcgtcgcgccgaacctgtcgatcacggccgactcgacgctcgacaacagcggcggcaagctcgaggccaatcagattgcgctcacggcagaaaacctcgtcaaccacggcggcacgattacgcagtatgggtcgtcaacgatgggcatgaatgtcagcggcacgctcgacaactcggccgctggcgtgatccagaccaacagcacggatctgacgctcaagcccgccgagctgaacaacgcaggtggcaacatcacacatgccggcacgggcacgctgacgatcgcaccgggcaatggctcgagcgcgctgaacaacacgtcgggcaccatcgtgacgaagggacaagccatcgtcaacgcggccgcctggaacaacgcgagcggtatcctcgccgcgcaacgcggcatcaatgcgacgatcgcaggcgatgtgaacaacgcgcagggcctgctgcgatcggacgcgtcgctgtcgttgaagagcggcggtgccttgtcgaaccaaggtggccacgtccaggccggacaatctactgctggtgacaccagcacactcgacattcaatcggcttcgatcgacaacgcggacggcgccattgtcgacctcggtgctggcaagatgacggtgcaaggcgacaaccagatcgcgaacagtcatgccggcggtgtgtcgggcatgggtgcgattaccggtaacggcgacgtgacggtcagcgcggcatcgatcagcaatacgcagggcggtcagctcagtggtgcatcgctgcatgtccagggaactcgctcgacaacagcggcggctttatcggtaacgtcacgaattcgaacggcaacgtgaacgttacgacggccggcgcggtcacgaacacgaacggccagatcggctcgacgcacgacctgtcggtcgcagcggccacgttgcaaggtggcggcacatacagcgcagcgcacgacgccaacgtgaacctgcagggcgactacacggcggcatccgatacgcagttcaacgtcggtcacgatctcgcgttcacgttgcccggcaccttcacgaacaacgcgaacctgcagtcggtcaacaacctgagcgtcaatgcgggcaacatcgtcaacgcgggagccctgacggccggcggcttgctgcgtacgcagtcgaccgatctgaccaacacgggggcgctggtcggcgccagcttatcgctcaacgcgacgaatacgatctcgaaccttggaccgaccgcgttgatcggcggatcggacagcaacggtatgctcgaaatcctcgcgcatgacatcgaaaaccgcgacgacacgacggccaccgactcgatggcgacgacggcgatcttcggaatgggcaaggtcgtgctggcaggaggcaaggacgcaagcggcaattacacgaacgccgcgctggtcaacaacgtgtccgcgctgattcagtccgaaggcgatatggaattgcatgcggacaaattgacgagcacgcgccgcgtgatgaagacctcgacgagttcgatcgatccatcgctgctcggccagttcggtattccgatcagcggccgtactggccaggttggcgtgaaggatccgtacagcatcggcggcgtctacaccgagccgcctcacggcggtcagtggaacagcacgtatcagttcacgacctactatgcggacagcgcgacggcgacgaccgtaacggacatcagcccggctgcccagatcgtgtcgggcggcaagatcgaggcctcttcggtcggtacgctgcagaactactggagcaacatcgcggcggtcggcgacatcaagatgccagcccgctacgacgccgacggctgggcggcgtccggccagaaactgccgggcgtgtcggtttcctactcggggcaatatcactacaacaattacgataattccgaatatgactggaagcttccgttcggcaatgcgccgtttgtcggctctcggccgggtggctacacgcaggcggcgccagcatcgatcaaagactacaagctgccgcgttacgatgcgacgttgaattcgaacggcacgatttccggtactggagtgagtgtcaacaactcggcgggcaatgcatcgattccgtcgctcggcttgctgccgggacagtcggtgccgggtctcacgcctaccaatctgagtgggaacgcgagcggtgcgaaatcgggggcgtcgtccgtgcacggtggtgcgcccgcgccggtcgatccgatcatcgccagcgcgacggcgctgaacgtgctgaacaatctcgccattccgcagggcggattgttcaagccgactaccgcgccgaacgcgagctatgtgatcgagacgaaccctgcgttcacgaaccagaagaatttcatttcgagcgactacttcttcggccagctcggcgtcgatctcacgcatattccgaagcgactcggtgacggcttctacgagcagcagctcgtgcgcaacgaagtcacgtcgttgaccggcaaggcggtactcgggccgtacgccgacctggagacgatgtaccagtcgttgatggcggccggtgcgagcctgtcgaagtcgctcgatcttccgatcggcgcgagcctgtctgccgatcaggtatcgaagctgaccagcaacgtaatcatgatggaaacgcgtgtggtcgacggtcagtcggtgttggtgcccgtcgtgtatctcgcgaaggccagccagcagaacatcgacggcccgctgatcagcgcaacgaacatcgatttccagaacgcgcagtcgttcacgaacagtggcacgatcaaggcggacaacacgctggcaatccagggcaagcagatcgacaacgcattcggcgcgctgcaaagcggtgggctgatgtctctgaagacagagaacaacatcgatctgacgtcggcgaacgtgaaggcgggcagccttcagcttgatgccggcaaggacttgattctcgacacggcgacgaagacgaatgcgcgcgtgagtcgggacggcgcgacgagcgtggtgacgacgctcgggcccattgccaaactggatgtcgcgggcaacgcgtcgatcgtcaccggcggcaacttccagcagaacgcgggcaacctgtcggtcggcggcaacctcgggatgaacgtcggcggcaactgggatctcggcgcggtgcagacgggcgagcacaagatcgtgcagcgggcgaacggtgtgtcgaacaccgacatcaacaaggtcaccggcagttcggtgacggttggtgggcagtcgagcatcggcgtgggcggtgatttgacggccaagggcgcgcagatcgacctcggccagggcggcacgatcgccgccaagggcgatgtgacgctcggcgcggcgagcgcgacgtcgacggtcaacagcaacagttcaggcagtgatagtcacggcagctacgcggaaacgctgcacacgtccgatcaggcactgtccgggacgacgctcaagggcggcgataccgttacgttggcgtcaggcaaggatcttacaatcagcggtagcacgatcagcctggataagggtaatgcgaacctgatggcggccggcgatgtgaatatcggcgccgcaaccgaaacgcacgagttgaactctcacgaaacgcatagccacagcaatgttgtcagcggagcaaagatcgcgagcgggatcgaccagacggcgacctatagccaaggcagcacggtgtcggccgacggcgtcaacatcgtcagcaaccgcgacatcaacgtgacgggcagcaacgtcgttggtacgaacgacgtcaccttgcaggcgaagcgcgacgtcaacgtcacgacctcacaagacacgactcaatcgtccagctacttcgacaagaaggagtcgggtctgctcacgaacggtggtttgtctgtgacggtgggctcacgctcggccgcgcggcaagaccaaagcagttccgtgacgaacaaagggagtgtgatcgggtcatcgcagggcaatgtgacgatccaggcagggaaggatgcgtcgattacgggcagtacggttgttgcgggccaggatgtcggcatcacggcacagaacgtgaccgtaaatgccgcatacgatacctacaaggacgcgcagtctcagaagttcagccaatcgggtttgagcgtcggattgggtggcggcctggtcggactcggacagtcgatggcaggcgcggtccgccaaggccagcagtcgggtgactcgcgtctcgtggcagtgcaggcggtggcggcggccgagcaggcttaccagaaccgcggcgggatcaaggacgcggccaatgcactgtcgaacggcaacgtaagcgaggctgccaagggtgttcaggtacagctcagcatcggatcgagccatagcagcagcaatgcgacgacatcgatctcgagcgcgaaaggttcgtcgatcatcggcaacggcaacgtctccattaccgcgaccggcacgccggacgcgaacggaaatgttcaggcaggtaccggcaacatcgcgatgaccggagcgtcggtactcggcaagaatgttgctctcgacgccaacaacgcggtcacgctgcaaagcgcgcagagcaccgatcagagcacgagctcgaacagttcgaccggctggaatgcgggcgtcgcgatcggcgtgggcaagaacacgggcatcagcgtctttgcgaatggctcgaactcgcacggccagggcaacggcgacagcgtcacgcaaaccaacacgacggtggcggccggcaactcgctgacgatgaagtcgggcggcgacgcgacgctgtcgggcgccaaggtgtctggcgacaaggtcaaggtagatgtcggcggagacttgacgatgacgagccttcaggatacgtcgaactacagcagcaaccagcacaacacgggcgtcagtggcagctttacgttcggctatggtggtggcgtcgacgcgtcgatcggccataccagtatcgacgcgaactatgcgtcggcgaaccagcaaaccggcatcgtggcaggcaatggagggttcgaagtcaacgtgacgggccatacgcagctcaacggcgcgcagatcgcgagcgcggcgccggccgacaacaatacgctgacgaccggcagcctcggatttaccgacatccagaacaagatgtcgtattcgggctcgtcggaaggtttttcgacgtcgggtgggccgaactttgcgcagacgggtgacagcgcgagtggtgtcacgcatgctgcggtgagcccggcgaagattgtcgtgaaatcggatgagcagaacggcacggacagcacgtccggcctgtcgcgtgacacggcgaacgcgaaccagacggtggagaacacgtttaacctgcagaaggtccagaacaatatggccttcgcccaggcgttcggcaaggtcgcgactttcgcggtagcggaagcggcgacgcagctggaaaacagcagcccgcagatgaaggcgctgttcggcgaaggcggggcaggtcgtgacgcgctgcacgccgcagtggcggcgatcggggcggcgctgtcgggcgggaacgttggtggtgccgtcgcgggttctttggccggagacgtgttgcagtctctggcgcagccgatcatcgatcagacggtgagccagctgccgctgagcgcgcaatcggcggcgcggaacgcgctgaacgagatcgtggcgacggcaggcggagcggcggctggcgctgtcgcgggtggcgggtcatccggcgcgctggccggtgcaggatcagccatcaacaacgagctttacaatcgacagcttcacgtagaagaggtgaaggtcgtcgagcagctcgcgaaagaaaaggcgcaagcggtatgccgtggcgacgcgagttgcgttgcgaaggcaacgacctactggaccgacatgcttgagcgcgcggcgaagggaatggtcgacgacaccgccaacaaggaaaacatggcgtaccttcagacgctgatccagacggcgaacaatccgaccagcgaaggcgcaatgggcgggctgagctcctacctggcgaaccttcagaccgcgcaagatatgttgtcgcagtatatgggcaagccgattctggtccgcggcacgccgatcatctccgccggttcggctcagacgtatttcagtgcgacaccggagcaacgttccaatcaaagcctcaatgccatattgggctcgctgcctggctcaatcgtgccgggtgcgagccaacgtgatcagaatcgagtggattccttcgcgacgcaaaacggctccgtgaaacccgattacacgatcgaggaaacagtcatcggcggtatccttaccaacaaaatcgcgtcgacggccgcgcgcgtgggcgagtcgattgatgtttggttggcggggccggtgaatccgacgggcaaagggttcatcagcaccggcaagatgacgatggagagcatgccggtgaaattgaataccgcagaacaaggcgtgctgtcacaactcgaccagctgccgtccaaggatttgcagggacaggcccgtgaatatgtggcgaacaactacttcgtacggaatggctttacgccgcttgatgggaagtgtggggccaattgctttgacggcgtctacatcaagggcgacactgtctacgtcaatgaagtaaagccgttgaacaaatctggctcgattaacttaaatcctgaaaacccggcgaccggacttccgactcagcaaacggatacttgggtggaatacgccattaaacgtctgaaagacaccgaggacccgcaattcgttaacacggcaactgttatagaacaagccatgaaaaaggaaagctagtgaagttggtttccggagttgactccaatggaatggttattgtaaagattcccggaatgaaccatgacaaatcgaacagcattggataaattggcgaattttgttcaaattgagagagatggaattcccgagcttgttcatgatgtgatatatcgacgaaataaagttcgccttggtattgtttacaatgcattggcaagtcgtgcgcgagcacaggcagtttttgattatttttccgatagaaatatcgctgctagcaagcaaaatttttatctatcgtcaaaattttccatagcgagttgcgatttggatggaggtgctagtttcaccacaggacttgagatgctctgtgcgatcttgtctgataatgaaagtgttattgaggcagcggcacggatggaaacgtcagcgctgttgaatggaagaaatgatccaaaatcggcggcggcgtttcaatacagattccagctcgcgatcatgggtaaggatcaggagttggaggcgtgtatcgaggaggtgagaaaaagggaaccaaagctgatcgacaggccatttcaaatggtgagtatttttctcattgcttctagctcgcgatgccgcagggttaagggcgttgatcgaaaagcggcacgcaaacgtcaaatgcgtttggccggatttggagaacttcatctcataccttgggacgcttgagacaaaaatttgctggcgacgtggcatccaaattgaaattgaccatccgctggtgccaatggagctgatgccagtcaagccactcgatcactacgatgacgtctacgactttctgaagccggggtgggtgccgcctccgcagggactgattggccgcgtttcccggtggtttaagacgtgatcggcgcacatcgcactcgctttgaggcaacgatgaagaaatgcaaatggcccgtagccctagcgtttgtcatgtcgacgcttctcgctgcatgcgagaccgtgccacctgatgcacctccgcgtcctccaccgaagccggaaatggagcccgtgttgccgtcgtggtcgagcacgatctgggtcatgggcttctggaaatggagcggtaccgaatgggtttggattccgggacatttagcacccaaaccataaaatcgatcgaacaacgccacttctatgacaatccgtaccccggtcatgctgctgtcggccgcatggctgattccaatggccgcgtcggcgcaagaagctcccgcctgatcagttcgggtaacgaccagcaaatccgacaacaggaagaggcgcgcgagcgcgagcggaccgtctccgcgcctggggtgcgatcgaacgtgacggccagcgcggggtatccaaccctgccgtccgaaacgccctgctttcgcattgaccgtttcgccctcgacgttcccgatgcgctgcccgcttccctgaagttgcaaggcgcatcggcgttgccgatggatcgctttgccttcgcgcgtgaatggctcgaacactataccggtcagtgcgtcggcaaacaggggctcgacctgctcgtcaaaggtctgtcgcaagccatcctggcacgcgggtacgtcacgacgcgcgtgctgcttcccgaacaggatctgtcgaccggcaccctcaagttttcgctgatccccggcgtaatccgtcacgtgcgtttcgccgacgaaaagctccgcggcacctggaaaacagccttcccgaccggcgacggcgaactgctgaacctgcgcgacctcgagcagggcctcgagcagatgaaacgcgtgtcgagccaggacgtgtcgatgcagattgtcccggccgacgtgcctggcgagagcgacgtcgtgctcgacgtgaagcgcggcaagccgtggaccgtcgtcgcctcgatcgacaactcgggcacgcgggcgaccggccgcctgcagggcaacctgtcgctcggcatcgacaatccgctcggcctgaacgacatcttcaacatcggcgtgagccaggatctcgagttcggcgacaagcggctcggctcgcacggctggaacggcttttattcgatcccgtggggctactggaccgcaacgctctccgcatacacaagcacgtactaccagcagatcgccggcgtgaaccagtcgttcatcgcaagcggcaattcgaagacggtcgacctcaagctgagccgcgtgctgtcgcgcagccagaacgacgtgttcggtgcgcagttccggctgtcgcgccgtttcgggcaaagcttcatcgaagacaccgagatcccgcagcagcgccgcaacaacacgttcgtcgagtttggcctgaccgatcgccattacttcggcaacgcgcagttcgacggcacgctcgcgtaccggcagggcatcggcgcattcggcgcgcaggacgacagcttggctgccgacggcggtccgacgtaccgctacaggatggcggtgctcgacgcgaacctgtcggtgccgtttgtgatcgcgcagcagccgttacgttacgtgacgacgttccacggccagtacacgggcaacacgctgtactacattgacgacctgacgatcggcagccgctatacggtacgcggctttgacggagagacgatgctggcggcttctcgcggcttctactggcgcaacgaattgcaggcgccgatcgggcagacgggtatggcggtctacgcgggcctcgactacggtcgagtgtggggcccgcagccggtcgcgctggtcggcacgcaactggcgggcgcggtgatcggcgtgaagggcagcgtcgcgactcgattgggcgcctacggttacgacctgtttgccggcacaccgatctacaaaccatccggattccaaacggcacgcgtgacggtgggttttcaggtcacggcacagttctaatgaagcgagcgcaatgcggcactcggcccgccgtcgtcggagagggtggtggcgaggctcgagagctgacgacttcgaccgtatagagcggggtactgttgtcggaaagccccgaacggcgaccttgctctccacgtccggcggtggaaccctaccctaccgctatctcacggcacgacgccataaacccccgcgccgccacccgaatcgcatccaccatcaccgcgacggccggcgaatgcagccggtcggtgcgcgtgatgatcccgaaatcgtccatccggcaatccatctccagcggcagcaccgtgacgatcccgtgccgcgcgtagtagcgcgcgacgtcctcggccagcaccgcgatcatgtcgctctgttcgagcagttgcgtgatgaacagcagcgcggacgtctcgacgaggttcgccggcggcgcgaggctcgcgcgctggaacacgagctcgaagcgatggcgcagcacgctgccggccggcggcacgacccacgcggcgcgctgcacgtccgcgagcgccagcggcgcctgcgcgagcagcggatggccggtccgcacgacggccgccaccgactcgccggtcagcggctcgtagcgcagccgcagcttgtcgtgttcggcggaaagccggccgaccacgatgtcgatcttgtcctgcgcgagatgttcgagcagcacgttgctggtgtcgatctcgaccgatacgtgcaggcccgcatgcgtgcccttcaccgcggccaccgccggcggcacgagccgcaagcccggcgacgtgatcgcccccaccgccacgtggccgagatggccggccttcagcgcggccagttcctcgtgcgcctggtcgaggctgccgagcgccgcgcgcgcgtgacggatcagcgcgtcgccgtacagcgtcggccgcatcccgcgcggcaggcgttcgaacagcaccgcgccgatcgactcctcgagttcgcgcagcagcttcgacgcggccggctgcgtcatgttcagcgcggccgccgcgcggtgaatgctgccttcgtcggcaagcgcgacgaccagcagaagctggcgcgtcttcaggcggccgccgtttccccacgggctggcttcgggcatcgtacgggtttatatcgatatcggaatcgatatcgtaatcgccaaaaacgtcattagccagttatcaaaattctgcctagactgcgccggtatcccgtcaccacaggactgacgatgtcggcaacaaaacccaggctgcgctccgcccaatggttcggcacgaacgacaagaacggcttcatgtaccgaagctggatgaagaatcagggcattcccgatcacgagttcgatggccgtccgatcatcggcatctgcaacacgtggtccgaactgacgccgtgcaacgcgcacttccgcaagctcgccgagcacgtgaagcgcgggatcttcgaagcgggcggcttcccggtcgagttcccggtgttctcgaacggcgaatcgaacctgcgcccgtcggcgatgctcacgcgcaacctcgcgtcgatggacgtcgaggaggcgatccgcggcaacccgatcgatgcggtcgtgctgctcgccggctgcgacaagacgacgcccgcgctgctgatgggcgcggcgagctgcgacgtgccggcgatcgtcgtgtcgggcgggccgatgctgaacggcaagctcgaaggcaggaacatcggctccggcacggccgtgtggcagctgcatgaatcactgaaggccggcgagatcgacctgcatcacttcctgtcggccgaagccgggatgtcgcgctcggcgggcacctgcaacacgatgggcaccgcgtcgacgatggcgtgcatggccgaggcgctcggcgtcgcgctgccgcacaacgcggcgatcccggccgtcgattcgcgccgctacgtgctcgcgcacatgtccggcatccgcatcgtcgagatggcgctcgaagggctcgtgctgtcgaaggtcctcacgcgcgcggcgttcgagaacgcgatccgcgcgaatgcggcgatcggcggctcgacgaatgcggtgatccacctgaaggcgatcgccggacgcatcggcgtgccgctcgaactggaggactggatgcgcatcggccgcgacacgccgacgatcgtcgacctgatgccgtcggggcgcttcctgatggaagagttctattacgcgggcgggctgccggccgtgctgcgccggctcggcgaaggcgggctgctgccgcacccggacgcgctgacggtgaacggcaagtcgctgtgggacaacgtgcgcgaagcgccgaactacgacgacgaagtgatccgcccgctcgaccggccgctgatcgcggacggcggcatctgcatcctgcgcggcaatctcgcgccgcgcggcgcggtgctgaagccgtcggcggcgagccccgagctgctgaagcatcgcggccgcgcggtcgtgttcgagaacctcgaccactacaaggcgacgatcaacgacgaggcgctcgacgtcgacgccagctcggtgctcgtgctgaagaactgcgggccgcgcggttatccggggatggccgaggtcggcaacatggggctgccgccgaagctgctgcgccagggcgtgaaggacatggtgcggatttccgacgcgcggatgagcggcaccgcgtacggcacggtcgtgctgcacgtggcgccggaggccgccgccggcgggccgctcgcggccgtgcgcaacggcgactggatcgagctcgactgcgaggccggcacgctgcatctcgacattccggatgacgaactgcagcgccgcctgtcggacgtcgatccgaccgcggcgccgggcgtggcggggcagctcggcaagggcggctacgcacggctgtacatcgatcacgtgctgcaggccgacgaggggtgcgacctcgacttcctggtcggcacgcgcggcgcggacgtgccgagccattcgcattgagcggcaggcggcgcgagaggtgccacaaacgcgcgccgcagccggttgcgggcccgcccgggcccgcttcgtgaaaccgtgaacgcatgacggcggtcgccaccgacgccgaagcaggacgcgaaccatgacatcgagcagcacgccgcgctatcgcggcatcttccccgtcgtcccgacgaccttcaccgacaccggcgagctcgacctcgcgagccagaaacgcgcggtcgatttcatgatcgacgcgggttccgacgggctgtgcatcctcgcgaatttctccgagcagttcgcgatcaccgacgacgaacgcgacgtgctcacgcgcacgatcctcgaacacgtcgcgggccgcgtgccggtgatcgtcacgacgtcgcactacggcacgcaggtgtgcgcggcgcgcagcctgcgcgcgcagcagctcggcgcggcgatggtgatggcgatgccgccttatcacggcgcgacgttccgcgtgccggaagcgcagatcttcgatttctttgcacgcgtttcggacgcgatcgacatcccgatcatgatccaggatgcgccggcgagcggcacggtgctgtccgccccgttcctcgcacggatggcgcgcgagatcgagcaggtcgcgtacttcaagatcgagacgcccggggcggcgaacaagctgcgcgaactgatccggctcggcggcgacgcgatcgaggggccgtgggacggcgaggaggcgatcacgctgctcgccgacctccatgccggcgcgaccggcgcgatgacgggcggcgggtttccggacggcatccgcccgattctcgaagcctggcgcgaagggcgccacgacgacgctttcgagcgctatcaggcgtggctgccgctgatcaatcacgagaaccgccagtccgggatcctcaccgcgaaggcgctgatgcgcgaaggcggcgtgatcgcgtgcgagcggccacggcatccgatgccggaactgcatccggacacgcgtgcggaactgctcgcgatcgcgcgccggctcgatccgctcgtgctgcgctgggcgcactgaacgaccaccgaacgattcgcgaaggaggcatgcacgatgagtgatcaggtttcgctgggtatcgtcggcgtcggcaagatcgcgcgcgaccagcatctgccggcgatcgacgccgaaccgggcttcaagctgaccgcgtgcgcgagccgccatgcggaagtcgccggcgtgcgcaactatcgcgacctgcgcgcgctgctggccaccgagcgcgagctcgacgccgtgtcgctgtgcgcgccgccgcaggtgcgctacgcgcaggcgcgcgccgcgctcgaggccggcaagcacgtgatgctcgagaagccgccgggcgcgacgctcggcgaagtggccgtgctggaggcgctcgcgcgcgagcgcgggctcacgttgttcgccacgtggcattcgcgctgcgcgagcgcggtggagcccgcgcgcgcgtggctcgcgacccgcacgatccgcgcggtgcaggtgcgctggaaggaggacgtgcggcgctggcacccggggcagcaatggatctgggaaccgggcggcctcggcgtgttcgatccgggcatcaacgcgctgtcgatcgtcacgcggatcctgccgcgcgagctcgtgctgcgcgaggcgacgctcatcgtgccgagcgacgtgcagacgccgatcgcggccgaactcgattgcacggataccgatggcgtgcccgtgcgcgcggaattcgactggcggcacggcccggtcgagcaatgggaaatcgcggtcgacacggccgacggcgtgctcgcgatcagccgcggcggcgcgcaactgtcgatcgcgggcgagccggtcgagatcgggcccgaacgcgagtatccggcgctgtatgcgcacttccatgcgctgatcgcgcggggtgaaagcgacgtcgacgtgcggccgctgcggctcgtcgccgatgcgttcctgttcggccggcgcgtgcagaccgacgcgttcggacgctgactacgcgggcgcgccgcggcgcgatcgcgcacgacgaatcattacggcacaagccgacatcaaggagacaccgcatgaaccgcacgacccaaatcattcgccgacacaccctgcgcgcgctgctcgccgcgctgtgcatcgcgccgctcggcatgcagggcgccgcgcgcgccgacgcgccgctgaagatcggcttcctggtgaagatgcccgagcaggcatggttcatcaacgagcagaacgcggcgtccgcgctcggccagaaagagaatttctcggtcgtgaagatcggcacgcccgacggcgagaaggtgctggccgcgatcgacaacctcggttcgcaaggcgcgcagggcttcgtgatctgcgcgcccgacgtgcgcctcgggccggcgatcgccgcgcgtgcgaagcgctacaacatgaagttcgtgaccgtcgacgaccagctcgtcgattcgaccggcaagccgctgtcgaacgtgccgcacctcgggatgtcggcgaccaagatcggcaaccaggtcggccaggcgatttccgacgagatgaagcgacgcggctggaagcccgaggaagtcggcgcgctgcggatcacgaactacgagctgccgaccgcgaagctgcgcaccgacggcgcgacgcaggcgctgctcgcgaacggcttccgccaggagaacatcttcgatgcgccgcagaagacgaccgacgacgaaggcggcttcagcgcggccgcgccggtgctcgcgcggcatccgaacatcaagaagtgggtggtctacgcgctgaacgaggaaaccgtgctcggcgcggtgcgcgcgaccgaacagctgcatattccggccgccgacgtgatcggcgtcggcatcaacggtgccggcgaggcgttcgccgaattccagaagaaggagccgaccggcttctacgggacgatcgccgtcagctcgacgaaccacggcaaggacagcacgcagaacctcgtcgactggattcgcaacggcaagacgccgccggccgacacgcagacgagcggcaagctgatgacgcgcgcgaactggcaggccgtgcgcgccgaactcggcatctgagcgtgcggggcgagcaagcgatgacgacgcagacgatgacgaccgtatccgccggcagcacggccgccggcgcagccggcgtggcgaggccggacgcggcgctgctcgcgctcgacggcatcacggtgacgttcccgggcgtgcgcgcgctcgacgccgtgtcgctgtcggtgcgcgcgggcgaagtgcacgggctgatgggcgagaacggcgcggggaagtcgacgctgctgaaggtgctgtccggcgtgaaccagccgcaggccggcacgctgacgctgaacggcgcggtgcagcacttcgcgtcgacgcgcgcggcgctggaggccggcatcgcgatcatctaccaggaactgcatctcgtgcccgagctgacggtcgcggaaaacctgatgctcgggcgctgccgagccggctcggcgtggtcgacgaacgcgcgcttgccgtgcgcgcgctcgatgcgctggagcggctcggcgagcacatcgatccgggcattccggtgaagtatctgtcgatcggccagcgccagatgatcgagatcggcaaggcgctgatgcgcgacgcgcgcgtgatcgcgttcgacgaaccgacgagttcgctgtccgcgcgcgagaccgcgcaactgttccggatcatccgtgcactgcgcgcggaaggccgcgcgatcatctacgtcacgcaccggatggaggaagtgtatgaactgtgcgaccgcgtgaccgtgttccgcgacggccgtcgcatcgagacgttcgaatccgtgaccgatctcgatcgcgaccggctgatcggctgcatggtcggccgctcgatcgaggacgtgtacggctaccggccgcgtacgcccggcgacgtgctgatcgaggcgaaggggctggcggggcccgggctcgccgagcccgtgtcgttcaccgcgcggcgcggcgagatcgtcggcttcttcgggctggtcggcgcgggccgctcggagctgatgaagctgctgtacggcgccgcgcgcccgagcgcggggcacgtcgagctgaacgggcggcgggtcgcgttcgggagcccgcgcgacgcggtgcgcgccggcctcgcgctgtgcccggaagaccgcaagcaggaaggcatcgtcgcgatcgcgtcggtggccgacaacctgaacatcagcgcgcgccggcatttcagcccggcgcgcatgctgctcgacgggcggcgcgagcgtgaactcgcgcagcgctatatcgagcggctcgcgatcaagacccgcgacggcgacacgccgatcggcgcgctgtcgggcggcaaccagcagaaggtcgtgctcgcgcgctggctggccgagcgcatcgacgtgttcctgatggacgagccgacgcgcggcatcgacgtcggcgcgcgcgcggaaatctacaacctgttctacgaactcgcggaagcgggccgcacggtgatcctcgtgtcgagcgacctcgccgaggtgatcggcgtgtcggaccggatcatcgtgatgaaggaaggacggatcgcgggcgaggtcgcgaaggcgcaggcgacgcccgacgcgctgatcaagctcgcgctgccgcgctagcggcctgcagtcaaccggaaagcaactgatatgagccaggcaatgcaaccccaacgcacttccccgtccccgatgccgcggccacggccgcgccgcgcgcgcgcggcggcgtgtggcaactgatcaaccgctccggcatcgtgatggtgtttctcgtgctgttcgcgacgctgtcgctgacggtgccggacttcctcacgccgcgcaacatccagggcctgctgctgtcggtcacgctgatcggctcgatcgcggtgacgatgatgttcgtgctcgcgctcggcgaggtcgacctgtcggtcgcgtcgatcgtcgcgttctcgggcgtcgtcgcgtcgacgctgatcaccgcgacgcacagcgtcgtgctcggcatcgccggcggcgtgctcgcgggcggcgcggtcgggctcgtcaacggcgtgctgatcgcgcgctggcggatcaactcgctgatcgtcacgctcgcgatgatggaagtcgtgcgcgggctcgcgttcatcacgtcgaacggcgacgcggtgatgatctccgaggagcgcttcttcgatctcggcggcgggtcgttcctcggcatctcgtatccgatctggagcaacatcgtcggcttcgtcgtgttcggcttcctcttgcgccggacggtgttcggcaagaacgtgctggccgtcggcggcaacggcgaggcggcgctgctcgcggggcttccggtgatgcgcatcaagatcgccgtgttcgtgctgcagggctcgtgaccggcttcgccggcgtgatgctcgcatcgcggatgagcctcggcgatccgaagacgtcggtcggcctcgagctcggcgtgatctcggcgtgcgtgctcggcggcgtgtcgctgacgggcggcgtcgcgacgatctccggcgtgctggtcggcgtgctgatcatgggctccgtgcaggacgcgatgagcctcttgaacgtgccgacgttttaccaatatctgatacgcggcggaattctgttgctcgcggtgctgttcgaccagtatcgtcgcaaccagcggcgcgcgatgaagatctgaccctgacgaacgcgcggccgcctgcgaaggcgacagacatcgggagacggcatgcaacagattcatccgggcgcggcggcgctgctcgtggacagccgcaacacgctcggcgaaggcgcgacgtggtgcgacgcggcgcacgcgctgtactggacggacatcgaaggggcgcggctgtggcgctgccgcgcggacggctcgggcctcgcgcagtggccgatgccggaacggctcgcgtgcttcgcgctgacgcacgatccggacgtgctgctcgtcgggctcgcgacgcatctcgcgttcttcgacctgcgcagcggtgcgttcacgcggatcgtcgacgtcgaacccgatctgccgacgcggctgaacgacgggcgctgcgatggggccggcgcattcgtgttcgggatgaaggacgaaggcagcgaaccgccgcaagcggtcggcgggttccatcggctcaatccggatctcacgctgcagcggctcgcgttgccgccggccgcgatcgcgaacagcatcgcgttctcgccggatgggtcgaagatgtatttctgcgattcgctggtgcgcgagattttcgtgtgcgattaccgcgcgggcggcgatgtcgcgaatgtgcgatcgttcacgcggctgaccgatgcggacggcgacccggacggctcgacagtcgatcgcgacggcggcctgtggaatgcgcagtggggcggccggcgggtggtgcgctacgggccggacggcgttgaaacggaacgcgtcgaagtgccgaccgcgcagccgagctgcgtggcgctcgacggcgaaggccggctgtacgtgacgagcgcgcgcgtcgggctgagcgacgccgcgctggcgagcgatgccgacgccggcggcgtgttcgtcgcccgcacgcgctacgcggggctgccgaccgcgcggttcgcgggcaagcccgcgaactgagcgcgccggtgcgtgcggcggcgcgctgccggcgccgtcatggccggacgggtcacgactgccgcgcggcctgcaaccccagcaacgcgaccgcgttgtctttcagaatcagcgaatgcacgtcgggccggaacccggcgccctgaaaatcctcgagccagcggtccggccggatcagcggaaaatcggacgcgaacagcaccttgtgcctgagcagcgtattcgcgtatttcacgagctcgggcgagaagtacttcggcgaccatcccgacaggtcgatgtagacgttcggcttgtgcagcgcgatcgacagcgcctgctcctgccatggccatgaagggtgcgcgatcacgatcttcatgtccgggaagtcggccgcgacgtcgtcgaggtgaatcggttcggaatacttcagacgcagcccgccgccgccgcgcatccccgatcccatccccgaatgcccgctgtggaagacggccggcaacccgtattccgcgatcacctcgtagatcggataggcgagcctgtcgttcgggaagcatccctgcatcgtcggatggaacttgaagcccttcacgccgtgctcgtcgatcaggcggcgcgcctcgcgcgcgccgaagcggcccttgtgcgggtcgatgctcgcgaacgcgatcatcacgtcggcgttgtcctgcgcgaattgcgcgatttcctcgttcggaatgcgccgccggccgatgttcgtctcgcagtcgacggtgaacatcacgaagccgatccggcgctcgcggtaatgcgcgatcgtctccggaatggtcggccgacggccctgcttcagcacggtgccgaagtacttgtcggccgcgtcgtcgaatgccttcgcgaacaggtccggcggctggcagcacgacacttcggcgtgcacgtgcgtgtcgatggcgatcaggttgtcgatgtccaagcgtgtctcctcatgtcgtgatgcgtcggccggcacggcgcgaaatcggctgtccgggcccgtttaggggtttgtccggagccgcttccattctactttacatatcaggttacctgatagtaaattggtcgcgagtcgcacagggcggcatcgtcattggagaacgaaaatgggttacgaagggcgctggaaaacggtgaaggtcgaggtcgagggcgggatcgcatgggtgacgctgaaccgtccggacaagcgcaacgcgatgagcccgacgctgaatgcggagatgatcgacgtgctggaggcgatcgaactcgatgccgaggcgcaggtgctcgtgctgaccggcgagggcgacgcctggacggccgggatggacctgaaggaatatttccgcgaagtcgacgcgggcccggaaatcctgcaggaaaagattcgccgcgacgcgagccgctggcagtggcaattgctgcgcatgtatgcgaagccgacgatcgcgatggtcaacggctggtgcttcggcggcggcttctcgccgctcgtcgcgtgcgacctcgcgatcgcggccgacgaagcggtgttcggcctgtcggaaatcaactggggcatcccgccgggcaacctcgtcagcaaggcgatggccgacaccgtgggccatcgccaggcgctctactacatcatgaccggcgacaccttcaccggcccgcaggccgcgcagatggggctcgtcaacaagagcgtgccgcgcgcgctgcgcgacgaggtgcgcgcgctggccgcgaagctgctcgacaagaacccggtcgtgatccgtaacgcgaagcacggcttcaagcgttgccgcgagctgacctgggagcagaacgaggactacctgtacgcgaagctcgaccaggcgaactaccgcgatccggaaggcgggcgcgagcagggcctcaagcagttcctcgacgacaagagcatcaagccgggcctgcaggcgtacaagcgctgacgcgcgccgccgcacgcaaccggatccgagtggagacacggaaatgcacgaagtgagtttgttgatcgacggcgtgtcgcgcggcgcgtcggacggcgggaccttcgaccggatcgatccggcgacgggacgggtggcgtcgcgcgccgccgcggcgacgctcgccgacgcggacgccgcggtcgcggcagcggcgcgcgcattccccgcgtgggccgcgctcgcgccgaccgagcgccgtcggcggctgctcgcggcggccgaccggatggacgcgcgcgcgggcgaattcatcgaaaccggccgcgcggaaaccggtgcgatggcgaactggtacggcttcaacgtgatgctcgcggcgaacatgctgcgcgaggcggccgcgatgaccacgcagatcgacggcgcggtgatcccgtcggacgtgcccggcagcctcgcgatggccgtgcgccagccgtgcggtgtcgtgctcgggatcgcgccgtggaatgcgccggtgattctcgcgacccgtgcgctcgcgatgccgctcgcatgcggcaacacggtggtgctgaaggcgtccgagggttgtccgggcgtgcaccggctgatcggcagcgtgctgcacgacgcagggctcggcgacggcgtggtcaacgtgatcacgcatgcgccgcaggacgcgccggcgatcgtcgagcggctgatcgcgaacccggcggtgcgccgcgtgaacttcaccggttcgacacgcgtcggccgcatcgtcgcgacgctcgccgcgcagcacctgaagccggcgctgcttgaactcggcggcaaggcgccggtgctcgtgctcgacgacgccgatctcgacgcggcggtcgaggcggtcgcattcggcgcgttcttcaaccaggggcagatctgcatgtcgaccgagcgcgtgatcgtcgatcgcaaggtcgccgatgcgttcgtcgaacggctcgtcgcgaaggcgcgcacgctgaaggccggcaacccggccgcgccgggcgtcgtgctgggcacgctcgaaagcgcggccgccgcgcagcggatcgcggcgatggtggacgacgcgcgcgcgcacggcgccgcgctgccgctcggctgtgaagtcgacggcgcggtgatgcagccgacgatcgtcgacggtgtcacgcgcgacatgcagctgtatgcggacgaatcgttcgggccggtggtgaccgtgcagcgcgtcgacggtgacgctgccgcgcttgcggccgcgaacgacagcgagtacgggctgtcggcggcggtgttcagccgcgatatcgcgcgcgcgatgcaggtcgcgaagcagatcgaatcgggcatctgccacatcaacgggccgacggtgcacgacgaggcgcagatgccgttcggcggcgtgaaggcaagcggctacggccggttcggcagcaaggcgtcgatcgccgagtttaccgacctgcgctggatcacggtccagaccacgccgcgtcactacccgatctgagcagtcccggcgccgcggcgccccagttgagacaacgacacaatgaagtccccgcccggcgcgcgcacgcgcgcggggcggaaccgaccggagacagaacttggatgcggatccgacccaactgcgcgacgcggctgccgcgcagcgcgttcccgccggctatcgccccgtggcgatcggcacggcaccgccggagatcgtgcaacgcgacggctgctggaccttgcgcgcgacgacccgctcggcgcgtacccacacaggctgaccgaccggctcgcgagcggcgcgcgcgcgcatccggaccgctggctggtcgcgcggcgcgggcccggcggtacgtggatcggcatcacgtatgcgcagatgctcgagcgcgcccgcgcgatcggccaggcgctgctcgatcgcgggctgtcggccgagcggcccgtcgcgatcctgtcgggcaacgacctcgaacatctgcaactcgcgttcggcgcgatgtgggccggcattccgcatgcgccgctgtcgcccgcgtattcgctcgtgtcgagcgattacggcaagctgcgccacgcgctcgccgtactcacgccggggctggtcttcgcatcggacggcgcggcgtttcgtgccgcgctcgacgcgacggtgccgcctgatgtcgagcgcgtggtcgtgtcggcacccgacgggatggatggcgtcacgcgtttctcgtcgctgctcgacacgacaccgggcagcgtcgatgccgcgcacggtgcgatcaccggcgacacgatcgcgaaattcctgttcacgtcgggatcgacacggctgcccaaggcggtgccgaccacgcaccggatgctgtgcagcaaccagcagatgctgctcgagacgtttccgcagttcggcctggagccgccggtgctggtcgactggctgccgtggaatcacacgttcggcggcagccataacgtcggcatcgcgctgtacaacggcggcacgctgtacatcgacgacggcaagccggtcgccggcaagttcggcgagacgctgcgcaacctgcgcgagatcgcgcccaccgtgtatttcaacgtgccgaagggctgggaagagctgaccgcggcgctcgaaacggatgccgcgctgcgcgaaaccttcttctcgcgcgtgaagatgtatttcttcgcgggcgccggactgtcgcaggccgcgtgggaccggctcgagcgcgtgacgctcgcgcactgcggcgagcgcatccggatcatggcgggcctcgggatgaccgaggccgcgccatcgtgcatgttcaccaccgggccgatgtcgggagccggctacatcggcctgcccgcgcccggctgcgacgcgaagctggtgccggtcgacggcaagctcgaggcgcgctttcgcgggccgaacgtgatggccggttattggcgcgcgagcggcgacgacgcgcgcgaggtattcgacgaggagggctactaccgcagcggcgatgcggtgcgtttcgtcgatcccgcgcggccggagatcggcctgatgttcgacgggcgcatcgcggaggatttcaagctgtcgtcgggcaccttcgtgagcgtcgggcccatgcgcgcgcggatcgtgtcgaacggcgcgccgtacgtgcaggacgcggtcgtcacggggatgaaccgcgacgacgtcggcgtgatgatcttcccgcgcgtcgacgattgccgtcgcctggccggcgcggcaccggatgccgacgtgcgcaccgtcctgcgggcgcccgcggtgcgggcgttcttcgcggacctgctcgagcgcctgaaccgcgatgcgaccggcagcgcgacgttcgtcacgcggctgtgcgtgctcgatacgccgccttcgctcgatctcggcgaagtcaccgacaagggttcgatcaaccagcgtgcggtgctcatgcaccgtgcggcggtggtcgacgcgatgtacgaaccgggcgcggccgacgccggcgtgatcgtcgccggcgcggcgcgccgggcatgaggtgcgcgcgatgagcaacgcgtattgcgcgccgttgcgcgacatgctgttcgtgatcggcgaatggctcgatgcgccggcgctgtggcgccgcgtgcccggctgggcggagctcgacctgtcgaccgccgggcaggtgctcgacgaagccgcccgcttcgtcgtcgaacgcatcgcgccgctcgattcgaccggggatctcgagggctgccggttcgacggtgccggcgtgacgatgccggcgggctttcgcgatgcgtatcgcgactacgtcgacgccggctggccgacgctggcgctcgacgccgattgcggcggccaggggctgccgcatctgctcgacgtcgcgctgcaggagatgctcgcgggggcgaaccatgcgtggctgatgtcgccggggctcacgcacggcgcggtggcgtgcctgcgcgcgcacggcggcgagcgcctgaagcgcgacgtgctgccgaagatcgcgagcggcgagtggctgacgacgatgtgcatcaccgagccgcaggcgggcagcgatctcggcctgctgcgcacgcaggcagtgccggacccggccgccgacggctaccggatcagcggcagcaagctgttcatcaccggcggcgagcacgacctgaccgacaacatcgtgcatctcgtgctcgcgcggctgcccgatgcgccggcgggaacgaaggggctgtcgctgttcgtcgtgccgaagtggctcgacgcgccgggcggccgcgtgcgcaacggcgtctggtgcgacggcatcgagaagaagatggggctgaaggcaagcccgacctgcacgatgcgtttcgacgcggccgcgggctggctcgtcggcgagccgcatcgcgggctcgcatcgatgttcgtgatgatgaacgcggcgcgcctgcaggtcgccatgcagggtgtcgggcatgcgcagagcgcatggcaggccgcgtcggcctatgcgcgcgagcgcgtgcagggcagggcggcgccgatcgcgcaacacgccgcgatccgccgcatcctgctcgatgcgcaggcgatcgtcgaaggcgagcgcgcgatcggctactggatcgcgcactggctcgacgtcgccgcgcacgatccgcagccgccggcacggctcgcggcgtcgcggctggcatcgttgctcacgccggtcgccaaggcgttcttcaccgcgaacggcttcgcggccgcgtcgaacgcgttgcaggtattcggcggctacggctacgttcacgaatacgggatcgaacagacggtgcgcgattgccgcgtgtcgatgctgtacgaagggaccaacgagatccaggcgatcgatctgctggtgcgcaaggtgctggggatcgcggcgaggcgctgcatgcgctgctcgagtcgattcgcgcggaagccgcgcagagcgtccaggcggcagcggacgagcgggcggcggacgccggggcgcgcgtcgccacgctgtgcgcggacctcgagcgcgtgacggccggcgtgatccgcgcgagcgagcacgatccggatctgccctaccgggtcgcggacgactatctcgcgctggtcggctggctgctgctcgcgttcgcgtgggcgcgcacgctgcgcatcgtcggcgatgcgccgggagacgattcgttccgtgcgggcaagcgcgcggtcggcacctacttcttcgactatccgctcgcggcattcgcacaccggctcgcactggtggacgcgggctgccgcgcggcgttgccggtcgtcgcggcataaggttcgtccgagccgggcgtggacggcccgggcggctcgccggccggcacgagccgccgtgcgggccgattacgggccgatatacgggctgattacgacctgatatacggaccgcgtgaggtaagatggcccgcgatcctccttccgacacgttcatgagttcgacacccgtcaaaccggccggcacgaaacgcacggcccgcgccagcgaagccaggccgcgcatgcgttcgcagcagcggcttacctacctgatcggcaatctcgaccggctgctgcgccgccagatgagcgatgcgctcgcgccgctcggtgtgacgctcgcgcagtacacggcgctgtcggtgctcgaggcgcgcggcgcgctgtccaatgcgcaactcgcggtgcgctcgttcatcacgccgcaatccgcgaacgaagtgatggttgcgatggccgctcgcggcttcgtgacgcgcgaggccgatcccagccatggccgcgtgatcctgctgcgcctgaccgacgagggttcggcaatcctgcgcgaatgcgagcaggtgctgcggccgctcgaacgccggatgctcggcgacgacgtgagcgccgacgacgtcgcgcaggttcaccgcacgctcgagctgttcgtacgcaacctgcgcgactgagcacgccgccgcgtctttcgttccggtttctccggccgcgccgggccatgccgcggcatggcgcgggccacgaacgggttgcgggttaacaccgcgctcgcgacacttgaaatatcaggttacctgttattaaatcatcccgtccctcgacgggattttctttcgggttcttaatcaggttacctgataaatagacgagacccgatcacgataaagcaaggacaccgcgcatgcgttcagcgtatgccgcgcgagtcacggttaggagacgacatggacacttccgttgccgcaaggccggccgtcgcgacgacgctcggcctgtgtttcgcgatcgcattgctcgaggggctcgacctgcagtcggtcggcgtcgcggcaccgcgcatggcccacgaattcgggctctcggtttcacagatggggctcgcgttcagcgcgggcacgttcggcctgctgccgggcgcgatgctcggcggctggctggccgaccgggtcggccgcaagcacgtgctgatcgcgtcggtctgcctgttcgggctgctgtcgatcgcgaccgcgcaggtgtcgagcttcgcgatgctggtcgccgttcgtgcgctgaccggcctcggcctcggcggcgcgatgccgaacctcattgccttgtcgtcggaagcggtcgacgcacgctcgcgcagcagcgcggtggccgtgatgtactgcgggattccgttcggcggcgtgatcgcgtcgctgatcggcgtgctgctcgcaggcgacaccgaatggcggcacattttctatgtcgggggcgtcggcccgctgctgctcgcgccgctgctgctcgcactgctgcccgaatcgcgtgcgttcctcgacgtcagcgcatcgggcgcggcgcgccccagcgtcggacagacgctgttcggcggctcgcgcaccggcacgacactggcgttgtggctcagctacttctgcacgctgatcgtgctgtatttcctgctgaactggctgccgtcgctgatggccgcgaagggctcgcgcgcagccaggccgggatcgtgcagatcttcttcaacatcggcagcggcctcggcgtgctcggcatcggcatgtcgatggaccgcttgcgtccgtcgcgcgtggtcggcggcatgtacgcggggatcgtgctctcgctcgccgcgctggcgatcgcgcccggactcctgtggctgtccgccgccgcgttcgcggccgggatgttcgtcgtcggcggccagtcggtgctgtatgcgctggccgcgatctattacccgaccgcgatgcgcggcaccggcgtcggctccgccgttgccgtcggccgcctcggctcggtggtcgggccgctcgccgccgccgaactgctcgccatgggccgcagcgcgtcggtcgtgatcggcgcgagcattcccgtcacgctcgtcgccgccgtcgctgcgctgatgctgatccggcgcccgcaggcgcacgactgatttcttcccatttcaaccacgagcgccggtagagcgcgattacgacacaggtctggagacgaacaccatgaagcacaccaaagccttgctggcggccggcgcatgcgcgctggccgcgaccggcgcgcacgcgcagtcgagcgtgacgctgtacgggatcatcgacacgggcgtcgagttcgtgtcgcacgcgaacgcggccggcgaccacgtggtgcgcatgccgggcgtgacgggcgagctgccgtcgcgctggggcctgcgcggcaccgaggatctcggcggcggctaccaggcggtgttcacgctcgaaagcggcttcaacgtgcgcggcggcgatctcgggcagggcggccggctgttcgggcggcaggcgttcgtcgggctgaagggcggcttcggcacgctcgcgttcggccgccagtacacgatgacctatctcgcgctgcagggcgcggacatcatcggccccgacatctacggcctcggctcgttcgacgcgtacgtgccgaacggccgctccgacaatgcggtgacctacgtcggcacctatcgcggcgtgacgctcggcgccgcgtattcgttcggccgcgacggcgcgggcaccggcaactcgccggggcagggcacgtgcgcggggcaggtgccgggcgacgccacgcagtgccgcaactggtcggtgatgctcaagtacgacagcgcgtatttcggtgcggcggcgtcgtacgaggagcagcgcggcggcaccggcgcggccgccaacttcttcgacggcgtggcgcccgttcctttcacgagcagcggcggcaaggacgcacgcacgcacgtgagcgcgtatgcgcaggcggccggcgcgcggatcggcgcgggctggatcgggcggcgcgtgtcgaccggttcgccggccgcgccgggcgcgcattccgacctgttcttcgtcggcgcgtcgtatgcggtcaagccggatttcgtcgtcgacggcgagggctaccggatcgtcaacagcgcgcacgacacgcgcgcgacgatggccacgctgcgcgcgacctatctgctgaccaagcgcacggccgtctacgcgcagtcgtcgtatctgtggaacagcgcgcatgcgcgctacgcggtcagcggcggcgggccgggcacgacgcccggcgaagggatggggcagctcggcgcgatggtcggcgtacggcacatgttctgattcggcagcctgacgaacgagggatatcttgaacagaaaatctgcattcctgtgcattgcgccgctgtccgcggcggcgatgcttgccgggtgcggcggcgacgattcggtcaacgccacgccgacacatatgagcgccgcgacgccggccgcgatggcgcagacctgcgacgcgctcgccgcgaagctcgcgtatgcgaacacgtcgttcacgtcggtgacgaccgcggccgcgggcacgctgaaggtggccggcaagccggtcgccgagcactgcgtgatcgaagggaagatgaacgagcgcgtgagcgcggtggacggcaagacctacgcaatcggcttcgagatgcgcttgccgaaggcgtggaacggccgcttcttctaccaggcgaacggcgggctcgacggcaatgtcgtgaccgcgaccggcgagatcggcggcggcgggccgttgaacgatgcgctgaacatggggttcgccgtgatcagttcggattccgggcacagtgccgcgcagaatccgctgttcggcctcgatccgcaggcgcgcatcgactacggctacggtgcggtcgacgcgctcacgccgatggcgaagcaggtgatccggctcgcatacggcaaggcgcccgaccgcagctatttcggcggctgctcgaacggcggccgtcacgcgatggtcaccgccgtgcgcaacccggccgactacgacggcatcatcgcgggcgatccgggctttcatctgccgaaggcggcgatcggcgagatgtacggcgcgcagcagttcgcgaagatcgcctcggcgaccgggacgaacgggctgccggacatccgcagcggcttcaccgatgcggagcggcagttcgtcggcgcgaagatcctcgagaaatgcgatgcgctggacggcacggccgacgggatggtgcaggacgtcgccgcgtgccaggcgcacttcagcgtcgagtcggacgtcccgacttgcgcgaacggcacgcgcacgggcgcctgcctgacgcccgcacagaagaccgcgctcgagaacgtgttcacgggcgcacgcaacagcgcgggcacggcgctctacgcgggttttccgtacgacccgggcatcgccggtggcggctgggccgcgtggaagcagtcgaattcgatcacgctcgatccggccgcgatggcgttcacgttcacgacgccgccaaaaagcgccgcgacgctcgcgaacctgcccggtttcgcgctcggcttcgacatggacaacgacgcaccggcgatctttgcgacgaacggcacgtacacgcaatccgcgtggacgttcatgacgccgcccgacgagacgaacctgtccgcgctgaaggcgcgcggcgcgaagctgctcgtctatcacggcacgggcgacccggtgttctcgttcgacgacacgcgcgactggtatgcgcggctcgcacaggcgaacggcggcgatgcgtcggatttcgcgcgcttctatccggtgccggggatgaaccactgttcgggcgggccggcggccgaccagttcgacctgctgacgccgctcgtcgcgtgggtcgagcaggggcaggcgcccgctacggtggtggccgccgcgcgcgacgcgacgaacgcggtgccgagtgcggatgtgccggcgtcatggggcgcgggtcgtacgcgcccgctgtgcccgtatccgcaggtggcgcgctacaacggttcgggcgacgtgaattcggcggcgagcttcagttgccgctgacgtagccgtcgatgggaaacggccggtgcgcgcgatcgcgtaccggccgcttcatgtgtgcaatcgctcactcattcacccactcattcgcccggatcgaccggcacctcgagcccgaccttcacgcggctcatgctcaccagcgtcttgaaccgcttcacgttgttgttcgcgaagaacagctcgcgcgtgagcgcgttgtactgatccatgttgcgcaccgcgacgatcagcacgaaatcccattccccgtcacgtagtagcactgctggatctgcgggcagcgctcgaacgcacgcttcatcgcgtcgagctggtcgatctgctcgctttcgacctcgacgttgacgacgatcgtcagcggatgatcgaccttgtccggtgcgacgacggcggtgtagcgctcgatcacgccgtcgtccgcgagacgtttcaggcgccggttcacggccgcggtcgacaggttgacgcgcgcgccgagttcgctctgcggcgtctgcgcgtcgcgctggatttccatcagcagcttgcgatcgaacgcatcgagtggggtggtcatgatggtgcgtgaaacctcgaaagaatgagaaatttttgcgtatgagcggtcgattcggcgattttattgaccgggatgcgcaatattatttttcggaccgacggcgaacgcaacccgcgctttgcccgatccgacccacccgacgggccgccggcgcggccctgttcccgagcctttcgccatgctgatcgccaacccccgcgcgtcgcgcgccacctatccccacgcgctgcgccgcgtgatgaacatcgcgtcggccgacgaaagcggcgcgtggctgtcgcactggccgctcgtcggccacgcgcgcacgccgctgcgcgtgctgccggatctcgccgcgcggctcggcgtcgcgagcgtcagcgtgaaggacgagtcgtgccgctcgccgctcggcagcttcaaggcgctcggcgcgccgatcgcgctggtgcggctcgtgaagcggctgcgtcgccagcaggacctcgatccgcaagggctcgtcaccggccgctatgcgtccgaactggccgacctgacggtgatcagcgcgaccgacggcaatcacggccgcgcgctcgccgccgccgcgcgcgcgatcggctgcgggtgcgtgatcgtgctgcacgcgaatgtcgacgcggagcgtgagcgcgcgatctccgcgtacggcgcgcggatcgtgcgcatcgcggggaactacgacgaatcggtggtctgcgcggcacagctcgcgcaggcgaacggctggtatgtcgtgtcggatacgtcatacgacggctacgaagcgattccgcgcgacgtgatgcagggctacggcgtgatcgccgccgaggccgccgcgcaggcggcgcgggacgacgggcagccgttcacgcatgtgctgctgcagggcggcgtgggcggccttgccgcgggtgtcgcgagttatctgtgggagcgcgacggcgtggagcggccgcatttcatcgtcgtcgagccgcgccaggccgactgcctgtaccagagtgcactggccgggcgcgccaccaaggcgagcggcagcgtcgattcggtgatggccgggctcgcgtgcggcgaggcgtcgccgctggcgtgggatttcctcgagatgtgcatcgaccatttcatgctgatcgacgacgaagacgcggtgcaggcgatgcgcggcctcgcggccggcagcgaacgcgacgtgccggtcgtggccggcgaatcgggcgcggccggcgtcgcggggctggacgtgctgatgcgcgacccggcacgcgcgcggcaggtggggctcgacgcgcattcgcgcgtgctggcgatcaatacggaaggcgcgacggcgccgtccgtgtaccggagctgcgtcggcgaggcggccgacgccgtgctcgcgcggcagcgcgactggctggaccgcgcgacggtggcggcctgaacgacatcacgaccgacgacgaccgactacgaccgacgaggcaaacgcaatggacgcaatcgacacaatcgacgaaagcacgctgcagggcaactgaaggcctggcgccgccacctgcaccagcatccggagacgggtttcgaggaggtgaacacgtcggactacgtcgcgcgcatcctgacgacactcgggctcgacgtgcatcgcgggatcggcggcacggggctcgtcgcgaacctgacggccggcactggcaagcgcgcgatcggcatccgcgcggacatggacgcgctgaacatcgccgagcacgcgccgggccgcgaacatgcgtcgcgcacgccgggcaagatgcacgcgtgcgggcacgacggccacatgtcgatggtgctcggtgcggcacgactgctggccgagcgcaaggatttcgacgggaccgtgcgtttcattttccagccggccgaggagcatggccgcggcgcgaaggcgatgatggccgacgggctgttcgagcgtttcccggtcgacgcgatcttcggcgcgcacaacatgccgggcatgcgcgcgggcaccttctcgacgcgcgcgggcggcatcatggcgagcgaggacaacttcgtgatccggatcgacgggcgcggcacgcatgcggcgcgcccgcacatgggcatcgatccgatcgtgatcggcgcgcaggtcgtgctcgcgctgcagacgatcgtgtcgcgcaatctcgacccgggtcagcaggcggtgatctcgtgcacggagttcatcaccgacgggctgcgcaacgtgctgccgtcgacggtgacgatcaagggcgacacgcgcagctattcgcgcgacgtgcaggcgctgctggaaacgcggatgcgcgagatcagcgaagggatctgccgcacgcacggcgcggcgtgcacgttcgagtacacgcacgagttcgcgccgacggtgaattcgccggagtgggtcgatacggcggtgcgggccgcggcgcaggtcgcgggcgcggaggcggtgaatgccgacgtgcagccgatgatgatctccgaggatttcggcgcgttcctgcaggcggtgcccggcaatttcgtgttcatcggcaacggtgaagcgggtggcctcggcggcgtgccgctgcataacgcgacgtacgacttcaacgacgcgatcctgccggtgggcgcgcggtatttcgcggaagtggcgcggcgggcgttgcaggcagcctagcggatcgtcagccggcagccttcacgcgcccggccgagcgctgttccggcgcgtcggccgtgcgcgtgcgatcgaggatcgcgagcacctcgcgcgcggtgttttccgaatggctgcgcaatacctgcggcagcaccgcatggtcggggtcggcgagcgcggccatgatgtcctcgtgctcgtgcagtgactcggcccaacgcagcgtgtccgtgttcgcggcgccgcgtgcgcggtgcaccttcgacatcagcgacgcatagatgcccgacagcacggggttgccggccgcgtcgacgatcatctgatgaatctgctggttcagccggaaatactcgatgcgcttgccggcttcatgacactccaccattttccggtgcttcgcctgcagcgcggcgagcgtcgccgtgccgatccgcttgcgcagcaactcgcccgccatcgcctcgagcccgtgcagcagctcgaacgtcgagaccaggtcgtcgaggtcgatcgacgcgacgcgatagccgatgtactggcgatgcgtgacggcgccttccgcgacgagcaccttcagcgcttcgcgcagcggcgttttcgacacgtcgaacgcgaggctgagttcctttcgtcgatccgcgcgccgggcggcaattcgccctcgtcgatcatcacgcgcaggcgcgcggcgatctcggcggccatgccgcgcgtgcgcagaagcaggggattgcggggtgtctggctcatgatggtgcgagcttatcacgatatcggggcttaccctgcaccaacatcgtgataaaagaatctcaatcaaaccaagtgtttacgctaacggtaattataaatttctaatcctatactcggctccacgttgcgcgacgtcctgatcatcctcgttcactcctggagtccgtccatgtcttcaacctccggtgtcgccgccctgacggtcggcaaatccgctgttcgctggaagatattcgtcgtgatgctgagcctcatcgcgatcaactacgtcgatcgcgcatcgctgtccgtcgccatgccttacatctcgcaggagttcaatatcgggcccgcgatggagggtctgatcctcagctcgttcttctggacctatgccgtgatgcagatcccgggcgggatgctggccgaccggttcaagccgcgtatcgtgatcgcgacggcgaccgtgttctggggcttcttccaggcgatcgccgcgttgtgcacgaatgcaccgtcgctgctgctcacgcgcctcggcctcggcgcggccgaagcgccgatctacccggccggcggcaagctcaacgcgatctggatgacgcagaccgagcgcggccgcggcgccacgctgctcgacggcggcgcgccgctcggtgcggccctgggcgcggtgctgatcgccgggctgatcgcggtgctcggctcgtggcggctcgcgttcgcggtggccggcatcggcaccgtgctggccgggctgctcgcgtggcactacatccgcaactcgccgcgcgaacatgcgggcgtcaacgacctcgaagccgaatacatcgaggcgtcgcatgcgagcgatctcgcggccgagccggccggcgcgtcgggccgttcgcgcgacttcttcaagtaccgctcggtgtggtgcatgttcttcggctggatgtgcttcaacagcgtgttctacgggctgctcacatggatgccgaactacctgcacaaggtgcacggcttcgacatcaagcagatgggcggctcgaccttcatcatctttttcagcggcttcgtcggcgaactgctcggcggctggatcgccgacaagtggaaggccgcgggcggccgcccgaacgtcgtgatgcgcacgctgttcggcatcgcggcggtgatcgccaccgtgtcgatcttctcggtcgcgtatgtgaaggacgccgtcgtgtgcgtcgcgctgctgtcgtcgacgctgttcttcctgcgctggtgcgggctgtactggtgcatcccgtcgtcgctcggcacgcgcaacaagatcggcttcctcggcggcctgatgaacctcggcggcaacatcggcggcgtcaccgtgccgatcgtcgtcggcgcgatcgtgcagttcaccggttcctatttccttgcgctgatggtgttcgcggcggccggcgtcggcctgctcgtgtgctccagcgcgatcgactacgaaaacaagctccccgtctgaccgacccctttcactgcatcgactgcattcactggtagagagaaacccgtcatgaaaaaacgtaccctgctcggcatgctcaccccgtcctccaacacgtcgctcgaaccgctgacgagcgcgatggtcgccggcctgccgggcgtgtccgcgcacttcgcgcgttttccggtcaccgagatctcgctgacgggccaggcgctcggccagttcgacgacgacaagatcatccaggccgcgctgctgctcgccgacgcgaaggtcgacgtgatcgcgtggaacggcacgtcgtcgggctggctcggcttcgacgccgacgagcggctgtgcgagcgcatcaccgcggcgaccggcattccggccaccacgtcggtgctcgcgctcaacgagatcctgaagaagacgaccgcgcacgagttcggcctcgtcacgccgtatctcgacgacgtgcagacgaagatcgtcgacaactatcgccgttcggggctgaactgcatcgccgagcgtcacctgaacctgaaggtcaatttctcgttctccgaagtgacgggcgacgagatcggcaacatggtgcgcgaagtcgcggcggccggcccgcgcgcgatctcgatcttctgcacgaacctgaacgccgcgcacctggtgccggcgctcgaggaggaaacgggcgtcccgatctacgacacgatctcgaccgtcgtgtggaagtcgctgcagcttgccgactacgacacgcggcaggtgaagggctggggccgtctcttcagcgaagtgatctgaggcgggcgccatgtcgaacgatctcgatttcgtgatccggcacgccgacgtcgtcacggcggcggaccggttctcgtgcgacatcggcatccgcgcggggcgcgtggccatgctcggtcacgggctgccgcgcgcgcgcgcgcgagctcgatgcgagcggcatgctcgtgatgccgggcggcgtcgatgcgcactgccatctcgaccagccgatgcccgacgggctgcggatggccgacgatttcctgtccggcacgcgctcggcgctgtgcggcggcacgacgaccgtgatcccgttcgccgcgcaggcgaaggggcagtcgctgcaggcggccgtcgacgactatcatcggcgcgccgaagggcgtgcgctggtcgactacggctttcacctgatcgtcgccgatccgacgccgcacgtgctggcggaagaattgccgcggctgatcgcgaacggctacacgtcgttcaaggtgtacatgacctacgacgacctgaagctgaacgaccgccagatgctcgacgtgctgtcggtcgcgcgcgagcacggcgcgctcgtgatggtgcatgcggagaattcggactgcatcggctggctcaccgagcggctgctcggcgacggccacgtcgcaccgcgtttccatgcgcatgcgcggccggccgtggtcgagcgcgaagcgacgcatcgtgcgatcgcgttcgcggaactcgtcgacgtgccgatcctgatcgtgcacgtgtcgggcgcggaggcgatcgagcagatccgctgggggcagtcgcgcgggctgccgattctcgccgaaacgtgcccgcaatacctgtatctgacggccgccgatctcggccatgacgatcacggttatgaaggcgcaaagtgcgtatgcagcccgccgccgcgcgatccggcgaaccagcaggccgtgtggaaggcgctgaagcagggcgtattctcggtgttctcgtccgaccatgcgccgttcagctacgacgatccgtgcggcaagcatccgggcgggcgggccgtttcgttcgaccatatcccgaacgggattccggggctcgagacgcggctgccgctgctgttcgacggcgtgcgtcacgggcggctgtcgctgcaccagttcgtcgagctcacgtcgctgcgccccgcgaagctgtacgggctgtatccgcgcaaggggacgatcgcggtcggcgccgatgcggacatcgtcgtgtgggatccggacaagcgcgtgcggatcgcgaatgcgtcgctgcatcatgcggtcgactacacgccctacgaagggatcgaggtgacgggctggccgcgtcattgcctgtcgcgcggcgagctgctcgtcgaggatggccgcctgctcgcggccgagccggggcgcgggcagttcgtgccggccggcaagccgtgcctcgattgacgtccatcgatgtgagcgcccgttctacgcggctggcgcggtttcagcaggagcaaggatgagtatttccaacgcaatgcgcggcatcgcggccgcagcgatcgtcgccggttcatgcggcgggccggcgctggccgccggcggcgcgccgcaggacatgccgagcgtcgtacccgaatcggccggcgtcgattcggcgccgctcgtgcggctgtccgaatggctgcgccgcgaccggatggacgtgcgcagcctcgtcgtcgtgaaggacggcaagatcgtgttcgagcgctacggcgacggcctcacgcgcgatcacaactacgagctgtattcggtgacgaagacgatcaccgcgctgctcgccggcatcctcgacggcgagggcaagctcgccccgtcgacgaaggtcacgccgctgatcgcggccgcgcggcccgatctcgcgagcgaactcgcggacaagcgggacatcgagctgcgccacctgatgtcgatgtcgagcgggctgcgctacacgacgcgcgaaggcaccgatccgctgtactacgaagcgcccgaccggctgaaagtcgcggtgacgagccgcgcggcgcagccgcccggcacgcagttcgactacatcgacgtgaacccggtgctggtcggcacggccgtgtcgatcgccgcgcgcgagcgcgaggacgcgttcgcgcgctcgcggctgttcgagccgctcggcttcgcgcactaccgctggagtggcgccgacggtaccggcgcggtggcgggcggctggggactgcggctgcgtgcggtcgacatggccaagatcggcatgctgctgctcgacaacggccgctggaacggcaagcagatcgtgccggccggctgggtccggcagatgacgacgccgtcgccggccgcggccgattacggctactactgctggatcagtcacgtcgtcgaacacggcacgccggaattcggcgcgatgggcttcaaggggcagttcatcacggtgctgcccgcgcagcgcggtcgtcgtcatgacgagcctgctgccgaccgacggcggcttgcgcgacgcaacctacctgaacctgtatcgacggatggtgaacgactacatcctgcccgcgctgacgccggcgcagccgccggtcgagcgcgcggaaacgacgcaggcgctgcgcgacgagctggcgcgcagccgcgagacgaagggcgtgcccggcacggccgccgcattcaacgatgcgccggagatttgataaagatgacgaacatgatcgccaatccggatgcatggcccgattcgcggcggcccgcatcgcgtgccgcgcctttcatgcgccggctgctcgcgcggcttgcgacgctgctgatcggcagcggtgcgctcgcgccggtgccgacgctggcggcagcgcatgcggccgatgcactgccgccgctgcatgaaaccggtatcgaagccgctgcgccggaggacgccggcgtcgactcgcgcaagctcgtcgagctgtcgcgctggatccgcgagcagaagctcgacgtctacagcctgctcgtcgtgaaggacggcaagctgatcttcgagcgctacggtgcgaacgcgtcgcgcgattcgacctacgagctgtactcggtgacgaaggccgtgacgtcgctcgtcgcgggcatcctggtcgatcagggcgccgtgcatcttgacgagccggtggccgcgcggctcgccgcgtggcgccccgacctcggcggcgcgctcgcggacaagcgaggcatcgagctgaagcacgtgctgtcgatgtcgagcggactgcattacgacttcagcccgaaggacgatccgatctactacaccgcgcccgaccggctgaagcttgctgtctcggccgcgccgaaggtcgcgcccggcaccgcgttcgactacaccgacgtgaacccgatcctcgcgtcggcgatgttgagcgcggcggccggccaacccgtcgagcgctatgcgcaggcgcgtctgttcgcccgctcgacatgaagcgcgcgacatgggagcgcgcggatcgcacggggctcgtgtcggccggctggggctgcggctgcgcgcggtcgacatggcgaagatcggcatgctcgtgctcgacggtgggcgctggcagggaggcaggtggtgccgcaggcgtggatcgcgcagatgacgtcgccgcgtgtgtcggcgcatttcggctactactggtggatcaacaacatcgtcgaaagcgagcccgaattcgacgcgatgggcttcaaggggcaattcatcacggtgctgccgaagcgcaacacggtgatcgtgatgacgggcgtgctgccgattgacggtggcctgcgcgacgcggagaacgtgaagctgttccgccggatggtgaacggctacatcctgccggcgctcgatggcgggcgggcgtcggggccgggctcgggcggcgccgatacgcgtgcggcgctgcgcgacgagcttgaagtgagtgcgcgctccgcaggcgtgcccggcacgcaggtcgatccgacggatctgccgaagtagccacggcgatacgcgtgaggcgcagcgtgtggagccggaagcgagtgcgcgcgccgactgatctgcggaagtcgcgccgggcgtgcgtccggccgcgccgctgcgggcgggccggacgcgcggtgcatcacatcacgccagttcgcccaggcacgcgtcgaattgcgtgacgagccggtcgacatcgtcggccgtcgtttgcggacacacgagcatcatgttgtggaacggcgtgatcagcacgccgcgattcagcaggtacaggtgcacgatgtgctcgagttcgctgtcgagttgcgtgccggcaatcgtgccgttgcgcggcggcacgggtgcgaactggaactcggtgcgcgcgccgatacgcgtcacgcaccacggcagcccgtgtttcgcgatcgcctgttcgagccccgtcgccagccgcgcggcgagttcgaacatgtgcgcatacgcggcgtcggtcgcgacttcggcgagcgtcgcgcgcatcgcatgcatcgcgagcatgttcgcggtgagcgtcgtgccgatgcccgaatggccgtgcggcgcgttcagcttcgcctgcttcgcgcgttccgcgaactcggcgctgaacccgtacaccgcgcacggcacgccgcccgcgatcggcttgccgaccaccagcatgtccgcgtcgagaccgtgcgcgaccgcgtagccgcccgggccgctgctgatcgtgtgcgtctcgtcgatcacgagcagcgtgccgtagcggcgcgtcagctcgcgcgcggccgcccagaagcccgggtcgggcagcaccatcccgatgttcgtcatcgcgggctcggccagcacgcatgccacgtcgccatccttcagcgcggcttcgagcgcggccaggtcgttgaattcgacgacgcgcgtgttcgcgagcaggtcgtaggcttgcccgagcaggctgtcgcgctgcaccgggcggccgtcgacgagatcgacgaatacgtcgtcgaccgtgccgtgataacagccgttgaacacgacgatcgtgttgcggccggtggccgcgcgcgcccagcgcagcacgaagcggttcgcgtcgctggcgctcagcgcaaattgccagaccggcagcttgaagcggcgcgcgagttcgcgcgacacccatgcggcgtcttcgctcggcagcatcgtcgtataaccgcgcgtggcctgttcgacgagcgcgcgcgcgaccggttcgggcgcgtgaccgaacatcgcgcccgtatcgccgaggcagaaatcgacatagcgatggccgtcgacgtcggtgaacgtcgcgccgcgcgcctccttcacatatagcgagaacggcgtcgaccagtcctgcatccagtgcaacggcacgccgaacagcaagtggtcggacgcttccgcggacagggcgcgggagaccggcatggcttcggtgaacgcttggcgctcgcgatcgaacagcgcgcgggcgcggatgaggtcgactccgtggcgggaaggcaaaggcagctcctgggctgtgaagaaggagaaacgatagcgcggccggcagggggctgaacagaggcggaattaccgaggcgggttgggggcgggcggaaattggtgcgatcgactcccgtgtcctatttgattccgagatggcattggtgaatggaatcctgaaagaaccgtgcaggtttccatggatttttagcggacgttccgtgacctatcgttattgcatgccgtgacgagaggagcgcgtcggagcctgccggtaaaggctggcgatcgtatcctggcggcgtacgagacggcatccgccgactcggcgcgttcgcgtatgcggctgggtatatcgaattccacggggatattgccggctaattttgggataaatgaatcccggattttcctgcgatgacggaatcaggtgcccgaacgacaaccatccggaaaacggagcacttcaatgaagatcggaacacatctcaccgcactcgtcgcatgcggcgcattggccggcattgcccacgccggcccgacgtcgccgcaagccgtcgtcaagcggatcacgttgaccgcgcacattggtgacagcctgttcgtttcgaggccggacaacgtcgcatacgacgtggtcgaactgaccgcgacggatcgcgaccagcgggccctcggcgcaacgctgccgatccgcgtacggacgacgaatccagacatcaacgtcacattgctgcagccgctaaggctgtcgaatggccgcgacgacctgaccaacgcgaaggtcgtgctggcgggcagcgcggccgacgccgaaattactgtcgacgccgctcgcgtgctcacgctgggaaagcgtgggcacgacggcttcgacggttatgacgaaacccgtcaggtgaaggtcagcgcgcaagcgcgggctgccggcgacgcggcgccagccaatggacgttaccgtggcgacatggtgctgatcttcgagccggccgcctccgcagggcgcgatccggcgacaggaacgatcgcggcgacgggtgagtgagcaatcgacccggtgggcatcgcttggcgcgcgtttttcaataaaagtttttgcgcataaatattcacaacatctcgtcgggaggcgccgccagtagtcggcgccgacgaacgagacgattgccgggcaggcatgccggcatgcgcatgggcgagaggggcgagcgtttgcgtccgggcgcggccggcaaacgcgatcgccagaccggacgcgtcaagccagcgtcttgatcatgtggtgttcgtcgtagaaccgcccgtcgacgaacagcgagcgcggttccgtgccgaaccggacgaacccttgtgacgcatacagccgttccgcggtgccgttgacctcgttcacgcacagcatcagttgcttgcagccccacgcctgcgccgcatgcgcggtcgcgttttcgagcagcgtctgcgcgatgccctgcccgcgataggcgggatcgacgaacacgccccagatcgtcgccttgtgcgcgatcttcgcgcgcgcatcgcggcgcacgccggtgatgccgacgagcgtatcgccgtcgaatgcgccgaacacggcacgttcgtgggtcggcgtgatgcgtatcgcgaattcgtcgaccggcacctgcgattcttcgtcgagcgtcggcaggaaagaagtgggcgcggtgtcgaccgcacgcaggcgaacggtctggaaacgggcggcgtcggccgcgtcgagcaggcgagtcgtgatcgtcatcgagggattccggttgagggtcgtgcatgccggcgcgggccgatatggccgctatgaccgatacggccgcgggatgcatcgtactgatcctaacgggaatccggattgcgcgtgtcggcgttcggcgcaccgctcgccgtggccgcgccgttgcgttcagatcgcgtcgcgcggccgccgcgcgtcgccgtcgacgcagcacgcgagcacctcggcatcggtgtcgccgaggctcaggtacacgtgcccgacagcgctgtcgaagtacaggctgtcgccggcgccgagccggtacgcgtggccgttctcgaagcgcagctccagctcgccgctcagcacgaacacgaactcctcgccgctgtgccggatgtagtcggcgaagtccgacagcttgcgcgcatggatccgcccgcgcacgggcaccatccgcttgccggtcaggtcgttcgcgagcatcccgtacgcatggttcggcgtgtcgtagaccatctgctggccggccggcgtgaacgacggcgtcatcgcgccggcgggcgcgggccggccgaacatcgtgtcgaagtcgagcgcgagcgcatgggtgagcgccgcgaacttgtcgtaggtgagcgcaatgtcgccgcgctcggccttcgaaatcgtcgacaccgcgataccggaacgctcggacagttgcgcgagcgtcaggccgcgtgacttgcgcgcgtcgcgcagccgcgcggtcgacgcgcgtcgggctcggcatcgagcgggtgtgacggccaggcgcgggagcgcgggcgttgatgcgggtgagcgatcgcgcgacgggggcgttgagggagacggtgtcgcggcaatgtcggcggcgcatcatgtgcgccgcaccggcacgaaggatgaggatggggtgaagcaggtacgccgtcgcgccgaaccggccccgacgtcaaacgcgcgaagatgcgcccgatcaggtcaggcgcaccgcgtccgaatcaatatcgcgccagctgattgccgttgatctgcacgcgatcgcccggccggaggttgcccggcgactgcacgtcgaacgagcgcatcgtgccgtcgctgacctgcacgtcgatccggtagctgctcgggccttgcgcggcgcccatctgctggccgatctggttgccggccaccgcaccgccgagcgcaccgatcacggtcgccgcatcgcggccgtggccgcggccgaactggttgcccaccaggccgccgaccagcgcaccgacgacggtgccggccacgcccgacgggccgaccgaaccgttgaccggctggatgttcgagaccgtgccgtactgcgtgccgtagccgttgccgtattgctgctgattgccgtactggtcatacggctgcgacccgtattgctgctggttgccgtactgatcgtacggttgcggcgcctggttcggatacggctgttgctgctgcacgtagcccggttgcgaatacgcgggctgcgcgtagccgggcgtcgcgtattgctgttgctgcggataccccggctgtgcgccgtagtaacccggcgcgacgcaggcggtcagcggaagtgccgcgacggtgacgagcgaggcgaacagaacggtcttcgtggaaggcatgcgcatcatgatgattcctgcatcggcaacgggttcgccgacgaattccaggacgggtggcgaactcggcgtgagtataaggaatggctggtggcgcgtccggtgcggccgggtaacaacgtgtaaagtctgttgccgcgtaaatcgccgcccgggcagggcaatcgcgcaatgcccggcgagggcggcggcgcccgttcggcaactgcgatgacgcggatcgacagcggtccggcggcttatcctgcgaggcagtcggcccctcgatgccggcgcgcgaaacttcggcttcggcgacgtcacccgacgcgccatcggcatgcgggccgtcgccgacgagatcggaccccgcagccgcacgtggctggcacggcgtttgcgccgcgcatcgcgaaatcgaatgcgcggcatcgcgacatttaattggcctcggccggcgccgtccgatatcgtggccggactccctgccaacggttgcgccgtgccggctgcggttccttccctgtccgcgccggtgacgtgccgcgacggccccacattccgagccatgaccgatcgtatcttcatcaacgccgtcgacgccggcggccagcccatcaacctcgtcgtccgtgacggccgctttaccgcgatcggcgccgatcgtgcggccgcgcccggcgcggaaacgatcgacctcgacggccgcgtcgtgctgcccggtttcgtcgatggccatatccacctcgacaagagcttcgtcggcgatcgctgggtgccgcacgaaacggtctgcacgctgcgcgagcggctcgcggtcgagaagcgccagctcgcggccgcgccgccgatcgtcgagcgcgcgaatgcgctgatcgcgcaggccgccgcgttcggcacggtcgcgatgcgcagccacgtcgacgtcgatgcgacgacgggcctgtcgaacctgcaggccgtgatggccgcgcgcgagcaatggcgcggcatcgtcgatatcgaactcgtcgcgttcccgcaggccggcgtcgtcacgtgccccggcaccgcggagatcctcgacgcagcggtgcgcgaaggcgcggacgtggtcggcgggatcgacccgacgacactcgacggcgacgcggacggccagctcgacatcgtgttcggcatcgccgagaagcgcggcgcgaagatcgacatccacctgcacgagccgggcgagacgggcatcgcgcaactgctgcggatcgcggcgcgcacgcgcgcggggctcggcgggcgcgtgaacgtgagccatgcgtacgcgctcggccaggtgagcgacgacgacgtgcggcgcaccgcggcggcactggccgaagccggtgtgtcgatcctgacgaatgcgccgggcgactgcgcgtttccgccggtacagccgctgcgcgacgcgggcgtgcacgtgttcgcgggcaacgacaacatccgcgacgcatggtggccgtacggcaacggcgacatgctgcagcgcgcgatgatggtcggctatcggtcgggcttctacaccgacgaagcgctcggcatcgcgctggacatggcgacgcatgccggcgcgcgcgtgatcggcaaggagaactatggaatcgcagtcggccacgacgcgacgttcgtcgcggtgcgtgcgccgaatgcggcggcggccgtcgcgggcgtgccggccgagcgctgggtattccgccgcggcgaaagcgacacgggcgcgccgttcgcccctgcgctgcgcttcacgcgctgaccgacccggccggcggcacggcacgcgccgtgctccgatgcaccgactgtaccgaccgcactgactgaccacaccggaaccgacatgacgaacctgctgatccgcaacgtccgcccgagcgccgacgccgcgctcgacatcctgatcgaaggcgaccgcatcgcgcgcatcggcccgtcgctcgacgcgcccgccggctgcgcgatcgaggacggcgcgggggcgctcgcgctgcccggcctcgtcgaaggccacacgcacctcgacaagacgcattggggatgccgtggtatcgcaaccaggtcggcccgcgcctcgtcgaccggatcgagaacgagcgccactatcgcgcgacgagcggccacgacgccggcgtcgcgtcgctcggctggcgcgcgcattcctcgcggccggcacgacgcgtatccgcacccacgtcgatatcgataccgaagccgggctgcggcatctgcacggcgtgctcgcgacgcgcgagacgctgcgcgggcaggttgaaatccagatcgtcgcgtttcctcaatcgggcgtgctcaagcggccgggcaccgacgcactgctgtccgacgcgctcgccgccggcgccgatctgctcggcgggctcgacccgtgcgcgatcgaaggcgatccggtcgaggcggtggacgtgctgttcgcgatcgccgaacgccatggccgcgggctcgatctccacctgcacgagcgcggctcgatgggcgcgtattcgctcgacctgatcctgcagcgcacggcggcacacggcatgcagggcaaggtgacgatcagccacgggttctgtttgggcgatatcgccgaacgcgagcgcgatgcgctgcttgcccggatggcggaactcggcgtcgggctcgtcacgaccgcgccggcggcggtgcccgtgccgccggtggccgcgtgccgtgcggctggcgtgacggtcatcggcggcaacgacggcgtgcgcgatacgtggacgccgtacgggtcgcccgacatgctcgaacgcgcgatgctgatcggcatgcgcaacgattttcgccgcgacgatgcgctcgaggtcgcgctcgactgcgtgacgcacggcgcggcgcgcggttgcggcttcgacggttacgggctgcagccgggcagccgcgcggacgtcgtgctggtcgacgcgctgacgttcgccgaggccgtcgtcgcacggccggtgcggcggctcgtcgtgtcgtcggggaagatcgtggcgcgtaacggcgcgctggtctgagtgaaacccgagtgaagcatcgccccggtatgatccggttttcagccggatttcccgggagaagacgatgcgacgcacgaccgcggcacgggccgcacgatggatggcggcggccctgttcgccgtgagcgccgcgcatgcggtggcggccgggccgacggacgcgcagcaggaagcgaaccggcgcacggtgctcgcgttctatgaaaaaggcctgaacgagaaggatgccgacgccgcactcgcgtatgtcggcgatcgttacgtgcagcacaacccgaacgcggccgacggccgcgacggcttccgccaattcgtcgcgttcctgcgcgacaagtatccgcggtcgcacagcgagatcaagcgctcgttcgtcgacggcgactacgtgatcctgcacgtgcacgcggtgcgcgaacccggcacgcgcggcagcgcgatcatggacatcttccggctcgagaacggcaagatcgtcgagcactgggacgtcaatcaacccgtgcccgagcaggccgcgaacgggaacacgatgttctgacggggatcgggcgcgcggacgtgccgacgcgcccgcgatcgcgtcgcatcggccgtgccggcggcgtcgcggcgttcgttcgcttgctcgctggccgcatccggcgttctctttcctactgctcctcgtgctccagcatggccgcgagcgccttcgtcagttcgctgaccatcgggtcggccgtcggccgatgcaggatcgcgatgtccatgtgttcgatcggcgcgaaaccctgcttcgcggtcagcacgacgtgctcgtccgtcaccacgcgcgcgggcagcacgctgatgccgagcccgtcggcgacggcggcctggatgccgctcaggctcgacgtcgtgaagctgatccgccagcggcggccgcgctcctcgatcgccttgatcatgtcgtcgcgatagagcccgcgcggcggaaacacgacgatcggcaccgggtcgagatcgatcgacggatgcgcggcgctgtcgatccagcgcagcttctcgggccagcgcacgacggcctcgcggctgtcgcggcgctgcttgatcagtacgaggtcgagttcgccgcggtcgtatgcggcgctgatgtcgcggctcagcccgcacatcacctcgagcttcacttgcggatgctcgcgcttgaatgccgcgagcgcatgcgtcgtgcggcccgccgcgaaatcgtcgggcacgccgagccggatcgtcagcgcgaccgtcgcacccgacagcgcttccagcatctcgtcgttcaacgcgagcatgcgccgcgcataactgagcaccgtcacgcccgcgtcggtcggccgcacgtcgcgcgtgccgcggtcgagcaggcggtgcccggcgatttcctcgagccggcgcaccttctggctgaccgtcgactgcgtcgagtgcaggcgcgcggacgccgtcgtgaagctgccgcagtcggcgaccatcacgagcgcgcgcagcaggtcgatgtcgaacaggggtctattcatttctgcacttctgtggattcgaacatttcgttttcaaatgcgtgcgacgacttttaacatggccggatgccgtgggcaatcgcggtttcgccggacccggcgcggcgtcgggtggcgtcgcgggggcgcctgacggaacgcatcgaccgggcatcggcgtgcgccgcacgcaaggaggacaccggatgtttttcaaacggatcgcgatcatcggctcgtttgcgttgaccgcgctcacgtcggccgcggccgccgccgacggcggcgcgctcgagggccggttgcgcagcgcggccgaccgtggcgacgcgggcgaagtacgcacgctgctcgaacgcggcgcgccgatcgattcgtgcgacgggcagggccgcacggcgctgctgctcgcgacgcacggcaatcacgttgaggcggcgcgcgcgtgctgatcgacgcgggtgcggacgtcaacgcgaaggatgcgatccaggacagcccgtatctgtacgccggtgcgcgcggccatctcgacatcctgcggatgacgctcgcgcacggcgccgacctgagcagcacgaaccggtatcgcggcgccgcgctgattccggcagcggagcgcggccatgtggagacggtgcacacgctgatcgacgcgggcgtgaacgtcgaccacgtgaaccggctcggctggaccgcactgctggaggcgatcatgctcggcgacggcagcgagcgttatgtgcggatcgtgcagctgctcgtcgacgggcacgcgaacgtcgatctcgcggattcgaacggcgagacgccgctgcggcatgcgcggcggcgcgggtatgcggcgatcgagcgggtgcctgtatagacatcgttatttcacggaaatccggaaaaacgcgccctgtggcgggcgcgcgtctcgtagggtaaacacccgaaaatctcgtaaatccacgctatgcgcgtgtgttcagggcgtcatttccggcctctcacagtctcccgaccttaatccgagcattctgccttcccccgcttgcgctcaaaatttgagcggtctagactgcatcgcagttccatcgaagtcccagtctttcgcgcaccgcgccgggtgttccggcgcaacgccacccaccggacgccggcgcttgcgcgccgcgtcgagaccatcaaggacacgccatgaaccgcactgcaaggcttctcgttaccgcgctggcgttcgcgccgctcgtgtcgttcgcgcaggacacgtcgacgatccgctggggcatcgaccccacgtatccgccgttcgaggcgaagcagcccgacggctcgctcgccggcttcgacatcgacctgcgcaatgcgatctgcgagcagctgcgtgcgaagtgcgtctgggtcgagcagggcttcgacgggatgattccggcgctgcgcgcacgcaagttcgacgtgatcatgtccgcgatgacggccaccgacgagcggctcaagcagatcgacttctcgaacaagctgtatgcgtcgccgggcgcgctcgtcgcgccggtcggctcgaagctgctgccgaccgccgcgtcgctcgcgggcaagcgcgtcgggatcgaccagggcacgacgcaggaggcgtacgcgaaggccgaatgggcgaccaggggcgtgacgatcgtctcgtaccagaaccaggaccaggtgtaccaggatctcgtcaacggccgcctcgacgcgaccttccaggacaagacgcaggccggctactcgttcctgaagacgccgcgcggcaagggctatgcgttcgcgggccccgacgtgaccgacgtgcggatcaccggctacggcgtcgcgatgggcgtgcgcaagggcgacgacgcgatgaagaagcggctgaacgacgcgatcgtcgcgatccgtgcgaacggtacgtaccagaagatcgccgcgaaatatttcgacttcgacatctacggtgcgaagcagtagctgacttcggcaccgtgattcggtgattccgtgattcattcaatcgacaggcacaccatgacgagtatcgaggatcgcgtcgcgcaagccgtgacgcccgaactgatcgccgcgttccgcgaggaaggtgcggtctgcatcaagggcatcttctcgcccgacgaagtcgccgcgctgcgcgccggcatcgacgcgaatctcgcgcagccgagcccgcgcgcgaaagtcgcgagccggcccgacgatccgggctggttcttcgaggatttctgcaactggcagcacaacgacgcgtatcgcgacttcatcgtgcgctcgccggcgccgtcggtggccgccgcgctgatgggcacggagaacgtgcggcttcatcacgaccacctgctcgtgaaggagcccggcacgcggcagcgcacgccgtggcatcaggaccagccgtactacaacatcgagggcgacgacaacgtcagcatgtggattccggtcgatccggtgccgctcgaatcgacgctggaattcgtcgcgggctcgcatcgcgggccgtggctgatgccgcgcacgttcatggacaaggaagcgaagtggtttccggaaggcagcctcgcggacctgcccgacatcgaaggcgaccgcgcggccttcccgatccgccattgggcgctcgagcccggcgacatggtgtgcttccggatgctcacgctgcacgcgtcgggcggtacgcagaaccgtcggcgcgcgttctcgatccgcttcgtcggcgacgacgtccgtcacgcgccgcgccgctggaagacgtcgcccgatttcccgggctcgcggagcaactgcccgatggcgcgccgctcgaccacccgctgtttccggtcgtgtggtcgcgtggcgcggggcaggccggcacgctctgacgccggcgggcgggcgtgaaggacgcggcggccgtttctcgacgaaacggccgccgcgcgcatttgtgcgtgccggtgcgtgacgaaggatcaggtcgggtggcgcccggcgcccggcgaagcgcgagccgagccggtagcggttgcccggatgcaggaaatgcacgaacgtgacgggcagcccgttcgtccaggtgcggcgcgtgagcgtgaggcacggctcgtcggcgcgcatgtcgagcagccgcgcctgttcgccggtcggcagcgacgcatcgaccacgtgctcgatttccagttcgtagtgcgacacgttgttgtacaggtactcggacggcggttcgacctggaaatcctggtcgatgaaaccgggcgcggcggccgggttcacgtagcgatcctcgagctggatcgggcggccgttttcctcgtgcacgcacaccacgtgaaaaaccggcgtattgaccggcaggccgaacgcggccgcgacgtcgaacgacgcgggctcgctcgactggctcagcacgcggcagcggtattcgtgcccgcgcgcacggatttcgtcgcggatgtgcgcgatcatcagcaggttcgactgcggcttcgcctcggcgacgaacgtgccgacgcccgcgatgcgcttcagcacgccttcctcggtcagctcgcgcagcgcgcggttgaccgtcatgcgtgcaacgccgaactgcgcggcgagatcgagctcggacggaatgcggtcgccggggcgccagtcgcccgagtcgacgttctggcgaacgagcgtcttgatctgctggaacggtgcggtggccttcgtgaccatcggggatccttgcgcgaagaggtggcgaggctagtcgtcgtgactgacgatgaccaggatctccgcctgcgcggcgccgaggctgcgcgtgcggtgcgggatgagtgcgttgaaatagactgaatcgccggtcttgagttgcaccgtctcgttcgggaattcgatttcgacgcgccccttgtgcacgaacaggaattcctcgccttcgtgctcgcggaacgtcgatgcgacgaattcgtgcggcggatgcacgacgaacggcagcatcttcttcggcgcgacgccggccgcgatgctctcgaagcggtgtgcgtggctgtcggccgccgcgcccatcgccgtgcgctcgccggcgcgcgtgaccgtgatcagctcgcggttgcggctttccgagaacaactgttcgacatcgacattcagtgccttcgacagcttcagcgcgaccgcgatcgacggcacgctcaggccgcgctcgactttcgacaggtagctcttggtcaggcccgtctcgtcggccagcacgtcgagcgtccagcccttctgttttctgagcagcttcaggcgaatcgtcatggggcgccaggtgtccttcgaaaaacggattgtaacgcatgacacaaggtgtcctgtggtgtatcgtgtgtcacatgttctcgggaaagcggcgcgaacggcgtgaccgacccggcccattcaggaggtgaacatggcggaaacgctgaatctgacgaaggaggcgctggtcgccctggcggagcgccgtctcgacaacgaggtgggcgacagcggctggtccgcgcggcagaagctcgcgctcacgtgccggatcctgttcgacgccggccacgattccggcctggccgggcagatcacctgccgcgcgggcgacgccggcacgtactacacgcagcggctcgggctcggtttcgacgagatctcggccgcgaacctgctgcgcgtgaacgaggatctcgacgtcgtcgacggcgaaggcatcccgaatccggccaaccggttccatacatggatctatcgcgagcgcccggacgtgaactgcatcatccatacgcatccggcgcacgtcgcggcgctgtcgatgctcgagcagccgctcgtcgtgtcgcacatggatacctgcccgctgtacgacgattgcgcgttcctgaaggactggcccggcgtgccggtcggcaacgaggagggcgagatcatctcgaaggcgctcggcagcaagcgcgcgatcctgctgtcgcatcacggccagctcgtggtcggcaagacgatcgaggaagcgtgcatcctcgcgctgctgatcgagcgggccgcgaagctgcaattgctcgcgatggcggccggcgagatcaggccggtgccgccggcgctggcgcgcgaagcgcacgactggatttcgaagccgaagcgcgatgcggtgactttcgactactacgcgcgcagggcattgcgcacgcatcgggactgcgtcgcgtgagcgggcgattcgccgccgccgtgtccgaccatcactgaggattacctatcgtgtccatcctgctgaaaggcatcattgcctacccggttacaccgttctccgccgacggcggcgtcgacctcacggcgctcgacgcgctgatcgagcgtctgattgccgacggcgtccacgcgatcgcgccgctgggcagtaccggcgagagcgcgtacctgtccgacgcggaatgggaggcggtcgccaccgcgtcgatccgcgcggtgcgccggcgcgtgccgaccgtcgtcggcatttcggatctcaccacggcgggcgcggtgcgccgcgcgcgcttcgccgagcaggccggcgccgatgcggtgatggtgctgccggtgtcgtactggaagctcggtcacgacgagatcgtcgcgcactatcgcgcgatcggcgccgccatcggcatcccgatcatgctgtacaacaaccccgcgacgagcggcgtcgacatgtcgcccgacctgatcgcgacgatctgccggaccgtcgacaacgtgacgatggtgaaggagagcacgggcgacatcgggcggatgcaccgtctcgcgcaactgagcgacggcgcgattccgttctacaacggcagcaacccgatggcgctcgccgcgctcgcggccggcgcggccggatggtgcacggccgcgccgaacctgaatgcggcgttgccgctggcgctgttcgacgcgatgcgcgcgggcgacctggcgcgcgcccggacggtctttcaggcgcagctgccgctgctgcagttcatcgtcaacggtgggttgccggtgaccgtgaaggccgggctgcgcctgtgcggcttcgatgcgggcgaaccgagaaagccgctgatgccgctcggcgacgcgcgcacgcgcgaactcgaacgcctgctcgcggcattgcctgacggtgtgacgacatgagcgacgcggcgcggccggcgatctcggcctctatcggcgcggtgcggatcggcgcgagccggccgctggccggcacgccgcacgccagcgcgatcgacaagcagccggtcggatcgcgcttgtggctgggcgcgctcggctttgccggcgacgagcaggccgatgcgcggcatcatggcggccccgacaaggcggtgcaccactatgcgcacgatcactacgcatggtgggccgcgcagatcggcgcacgcgacgtgctcgcgcaaccgggtgcgttcggcgagaacctgtcgacgcacggcgtgacggagcacgacgtgtgtctcggcgacgagttcacgctcggcggcgccgtgcttcaggtgtcgcagtcgcggcagccgtgctggaagctcaacgcgcgcttcgatcatccgcggatggccgcgctcgtgcagcaaagcggccggaccggctggtattaccgcgtgctgcaggcgggctgggtggcgccgggcgacgtgctggcgctgcaccggcgcgtttatccgcagtggacgctgtcggcggtgctcgacgtgctgtaccggcgcacgctcgacatggccgcgctcgacgcgctgtgcgaggtcccgatactgccggccggctggcgcaggatgctcgacaagcgccgggcggagcggcaggtcgaagactggacgaagcggctcgaaggacgttgacgtccggcgtggctcagtggctcggcagttcccgcacgtcggcggtcggtaccgagccgaatgcatcgctcagcgcatagccgatcagctgtcgcgcggctgcctcgggcgtcgcgagcgcgccgctcgacttcaactggtcgaatttctcgcgcatcgggaagttgtcttcgctggtcgagcggatcgttgcctgcatgcccgtgtcgacgacgcccggcgcgacgctgcagacccgtaacgcgcggttcgcgtcgagcgcgaccgcgcgcgcatggtgatcgagcgcggccttggtcgcgcagtagacgctccagcccgcgtacgcgttgcgcgccgcgccgctcgacacgtgcaggatccggcattcggtcgtggccgatgccgcttgcgcgagcgcggccgacagcatcagcggcgccgcgacgttcacgccgaccgcgcgtgcgacgatcgccggatcctgcgcggcgagcgggccgatcggatcgacgatgcccgcgttgttgaacagcagcacgatcgacgcgccgtcgacgaagcggcgcagcgtgtcgccggccagccacgccgcgacggccggcgtgtccgacaggtcgagttcgatttcggagaatcggtcgccggcttgcgacgcgagggtcggatgacggctgcgcgacacgcccagcacggcgatgccttccagcagcagctgttcggcgagcgacgcgccgaggccgcgcgtgtgtccggtgacgatggcgcgcacgtgcggtgcggaagaggatgcggtcatggcggtgagcgggtcgaaggggtgaatggatgaacggatgagcggcgtcgacgggcgacgcgcatgcgtggcggcatggcgtgcgggacgggcgatgcgtggtgatgcgtgcgagagcgctcgcgccgcgccgcggacgtcggggtgacgcatatcgtagcgccggcatgcgtgtcgcgcaaacgccgccgcgtgcgaggcggcggaatcgccggcacggcgcgcatccgttgccgcgcggcaccggccggcaggcaggccggacgaaagccggctgcggcaagtgcgcgcggcggctggcgagtggcgccgggccgagcgacgcgagctatcatatggctcgcccgtgcgcgatgccggacgggccgcgactgtttcccttcacctgctgcacgctgcgacgccactcatgaccaccacgccggatacgcccacgccacgcgcccttcgcgaactcacgcccctcgaggcccgcattctcggtgtgctcgtcgagaaacagcacacggtgccggacacctatccgctgtcgctgaatgcgctgaccgcgggctgcaaccagaaaaccgcgcgctcgccggtgatgaacgtcagcgaggacgaagtcacgaccgcgctcgacgggctgaagcacctgagcctcgtgatggaaggcagcagcagccgcgtgccgcgtttcgagcacaacgcgaaccgcgtgctcggcatcccgagccaggcgatcgcgctgctgacgatcctgctgctgcgcggcccgcagacggccgccgagttgcgcctgaacagcgcgcgcctgcacggtttcgcggatatctcgtcggtcgaggcgttcctcgacgaactcgcggcgcgcgcgcagccgctcgtcgtccggttgccgcgtgcgccgggcgcgcgcgagaaccgctggatgcacctgatgtgcggcgaagtgaacgtggccgacttcgcgggtgcggatgccggcggggcggattccgtgccgccttcggaattcgaagcgctgaaggccgaacagaagcgcctcgcggatgaagtggcgcggctgaatgcgctggttctgcgaatggccggcgagcttggcatcgacgtcgacgcgcaaggcgacgcgtcctgacgtaaatgacggcgatgcatgcgcgtcgcccggccccgtcgccacgcggtggggccggggcgcgacgcggatagcgcccgcacagccgcgttacttcagcttgacgcccggtacgagataacgcgcgccgcccggcctcaggatcggcgcgagcgccgcgaacggcacatcgagttgcggcccgagacaggcgcccatcgcgtggccgatcccggatacgacgaacgagagcttgccgggtgcgtcgagttcgaacgccagatactcggggaacacatccgcgcacgacagcgagacgtctttgccgtctgtcacttgcagaccgtgtgttgccttgtcgcgcaactgcgtaatgaaactcaccagcgcggggctcgttgccggggcgccgtccttgcctgctttagccgcgtcgatcacgcgattccagtcgaggtacgtaccgcgcagcaggtcgaacgtgaccggatcgtagtgattgttcggatgagcgccgccgcagtacgtactgcccgattccacgatgccgagtgccgcaggtgacagccacgtgaccgtcacctgttcgtcgtcgtagccgccgagcgaaccggcggacggcccgtcgtcggaatagcgggtcgacgcgcattcgagcgcggcgagattcatctgccagtgctgctgttcgagcaggcggttgacccgtgtcatgaccgctggatcgggatggcggctcagacgcggatacatgagcttcgtgcgcgggtcgcgccacatccggtacgcgacggtgccgtctccgatctcggggccggccggctgcgcgtgcccggcaagcttcagcgtggcataaggcgcctgccgcatgtcgatggccacgccgcttgcgataccgctgccgacgccgccggcgatgctgttggtgacggcttcgacggacccgggcgcaaccgcatcgggatcgtattcagcgacgcgccgcagcgtgaagctgcgcgtcttgccggagcgcgcatcggtccagcggccgcgatagccggccttgtcccgcgtgccttgccaggtggccgcggcatgatcgaaatcggcttgctcgcggaatcccgacgcgtcgcgcgcatcgtcgggcaactgcgttcgcacgagcggttcgaccagttgcgcgggcgtgccgtgcagcggaatatcgacgccgtgctgcgcatagaagtagcggccggagatcgagccgtccgcggccgggcgatcgtcgagttccatcacgacggtgccggcgccttgcagcgtgccctcgtagaccgtgcgcggcgcggcatgcgcgaagcctgcgtgcagcgcgaccagcacccacgcgatccggatcagcgggcgcatcaccagcggcacccggtctgttcggacgcgtcgacatccagcgcgcggccgaacgcggtctgcttgccggtgcgcgcgttggtgtaggtcatcgaatagaccatcgcgccctgggtcatcatttcgtagcgcccgttgaccttgccgccgaccatttcgacccaggtcgtcgtgtactggtgcggacggctttcgtcgagcacttcatcctcctcatgttcgatcaccagcggcagggccgttttcgaatgcgcgtaccggaccatgccgcccgaccatttgactgcatcgtcatagtaggtgcgcatctcgaagcgcacgggtttgtcgccgtccgacctgaagcagaacacgtcggtggataccttggcgagtgccggaagcgacacgcaaagcagcacggttgcgaagattttttcatggtggcgtaagggaaacggagcggccagtcaaccgatgctgatccgcgaagcgcccgcatcgacgagccggaacagcagatcctccacggccgtttcgggcgcggagccgagatccgcattgacgcgccacccctgttccgcgcgaaccggctccgacaggtagtgaacgatcccgtgcaggccgtcttcggccggcgtgttctcgtcgtcggcatcgaaccacgcgaagaaccatgccttgaacgcgtcggccgccgcgctttcgtcgagaccgtcggcctcgatcgcggcccagtcccacacgaacgggcggatcgacacggccgccgtgtcgagatcgaacgcgaacggctcgaaatccagctgcgtggcggaatcgaccatcgccggctggccggccgattcgccttcggtcgcgatgatgtcggcccggcacggcagcgcgagcggcccttcggtggcgagcgtgccgtcggcacgccggtaggccggttcggcgatcacggccggttgtgcggccgctttcgcgagcaggtcggcatacggttggcgaatggcgcggagcagttcggagacggtcatcgtggcgtgtcggctgggcaggaaacgatcggtcacaggcaggcggtgcgccgtgcggccggcatcgcacgacgcggccgcttcggtacccgacagccgtgatcgtacggtacttccgcgaaacgaggacagtcggccgaacggccggcgcgctccgcatcgtgcggcggcgggtttagacgtttaccttcaaacaatggaaaacgcccgtcgagcgcattctcgatgtgcttcaattaatccggtttgtactcctactaaaactacgaactcggaacaggccggatcattctttcacaggagacagtcgatggcacggaaacggttttgacgcggcgcacacgatggtctgcaacaccgccgaacttccttcgatgaaagcaggttatcccaggggccccaaccatgtcctccagacgtttcatgctggccgcggcagccgtatccgccgcgctggcggtcgccgcatcgccggccagcgccggcgcaccggccgtgtccgatccgttctatatctacaccggcaccacgccgctggcatcgattccaccgggcacggtgctcaagacgcgcaacgtcacctatcacgtggccggcattccgaccgcgctgaccgcgcagcagttgctgtatcgcaccaataacgcgctgaaccagccggtcgtgaacgtgacgtcggtgatccggagccaggtcagcaacggccgggccatctcgtaccagtcggcttacgattcgctgaacccgtacgacgagccgtcgcaggtgatcgccggcgatcgcgacgtcacgaagatcatcaacgtcggcacgctgctctacagcgcggaatcgattccgctgtcgacgctgctgctgctcggctacaacgtcatcgtgcccgatacggaaggccagacggccgacttcgccgccggccccgaatacgggatgacgacgctcgattcgatccgcgcggcgctcaatacgccgtcgaccggcctgagtccgtcgagcaaggtcgcgatgatcggctattccggcggcgcgatcgcgacgaactgggccgcgcagctcgcgccgagctatgcgcccgagatcaaccggcagctcgtcggcgcggcggaaggcggtgtgctggtcgaccccgcgcacaacctgcgctatgtcgacggcagcatcgtgtggggcggcgtggccgcggctgcgctggccgggctgtcgcgcggctatggcttcgacctgacgccctatctcagcgataccggcgtcgccgtgttcaacgacatccagagccagtcgctcgcgtacatcctgccgaaatacacggggctgcactggggcacgctgttcaagccgcaatacgcgaacgacatcaacagcattcccgcgtacgtgacgtatgccaacaaggtgaatgccgggctggccgcatcgccgacgatcccgatgttcatcggccagggcaccgctggcgcgctggacggcaccttcagcagccaggtgggcgacggcgtgatgctcgcgtacgacgtgcgcgccctcgcgcagaagttctgcgccagcggcacgccggtcacgtacaacgagtatccgctcgagcatgccggggcgatcgtgccatgggtggccggcatgctgccgtggctctacgaccgtttcaacgggaaagccgcgccgagcaattgctggctgacgtcgctgctgccgagcaattcgctggcgcccgaaacgctgcactagccgcaccgcaccgcgcgacgcgacgcggcgcatggccgggcgacccttcacgggtcgcctttttcattccggaattgaccctggtcgcgtcaacgcggcctttgccgcgcccggccctcccgccggaacccttcgccgccccgcccgggtgccataatcgagcctgctcatcattacagacgtccccggagaatcaccatgcagaacctcgacaatccttcccacgatcgcgaggtaggcagcgccgacgcgacgcaggacaccacgcgcatcgacgacgtccgcatcggcgccgtgcgcccgctgatttcgcccgcgctgctgctggacgagctgccggtgccggccgccacgcagacgctcgtcgaggatacgcgccgtgcgatcggcgacatcctgcacggccgcgacgaccggctgctgctcgtcgtcggcccgtgctcgatccacgatcacgaccaggcgctcgactacgcacgccggctgaaggccgccgccgatacgctgaaggacgacctgctgatcacgatgcgcgtctacttcgagaagccgcgcacgacggtcggctggaagggctacatcaacgatccgcgcctcgacggcagcttccgcatcaacgaagggctgcgcgccgcgcggcaattgctgctcgacatcaacgcactgggcctgccggcgtcgaccgaattcctcgacctgctgagcccgcagtacatcgccgacctgatcgcatggggcgcgatcggcgcgcgcacgacggagagccagagccaccgccagctcgcgtcgggcctgagctgcccgatcggtttcaagaacggcaccgacggcggcgtgcaggtcgcgtccgacgcgatcgtcgcggcggccgcgagccatgcgttcatggggatgacgaagatggggatggccgcgatcttcgagacgcgcggcaacgacgacgcgcacgtgatcctgcgcggcggcaagaacggcccgaactacgacgccgcgcatgtcgacgcatgctgtgcggtgctgcgcaaggccgggttgcgcgaacaggtgatggtcgactgctcgcacgcgaactcgaacaagtcgcacgaccgccagatcgacgtcgcgcaggatctcgcgcggcaactgtcgcagggcgagcaccggatcgtcggcgtgatggtcgagagccatctcgaggcagggcggcaggatctgaagccgggcgtgccgctgaagtacggcgtatcgatcacggatgcatgcctgagctggacgcagacggagccggtgctcgacgtgctggcggaggccgtgcgacatcggcgagtgtattcgcgcaatgcgtgaaataacggcggcgggttgacgcccgccgtcgtcataggcgaggtggtgcgtcaacgaagatgggtgccgggcaagtgcttcattccgccagatacgcgctcgcccgcgttttcgccgtcacgtcgcgcgacgagcatcctgcccgcgcgtcttcccgcctcgattgtccgatagccgcgctcggcggctcggatatggctcgcttcggaaacttctcgcgaacgagtttgccctgcagaccatcacgttccatctcactatgcggatcgcgggtagttaggcctttataggcgaattagccctgtcgattggtgcagaagcatcaaatttaggacgaatcctatattccgtgccccctgattagtcagaatcctaatcaagcaatgcgttgggatagccggggtgcttgacatggcacctcatacgcaaacgcgctggagatttcgcggtcgccggaaagatcgggctgccgcttccatcccaagtcgacgaagggcttcatgactcgtgccgcgttcgtcgccgacgacgcggcggctctggtgtcacgccggcccgtatccgcggtggaaacgactggctgagccatgtcaggcatgtcgcaagtcattgggaagccgcctggaatttgcgtcgagcgacgcgtgatggctcgctaatgcgtgaaatagcgcgaaattgattccgtgtagataaggtatgcaaattattttcaacgagagataccacccgtatcgggtgttgcttgtcgcaattgccatgtcgcttgcctcatcggtcgtcagcgcaaacatgctggtctatcccatggcggcatcgatcgggggcggcaaggagtcggccgcggagctgcgcatctattcgaagtccgatgcgacgcagtacgtgaaggcgatcgcgaagcgcgtgatcgatccggcgacggatcacgagcgcgaggaggccagcatgaattccggtgacgacgcgatcgtgatctcgccggccaggttcgcgttgccggccggcggcacgcggctcctgagggtgattccgctgggcgtgccgaagaaggaggtgctgtatcgcgtctacctgcagccggtggcggcgccgtccgacgacgattccgcggcgaccggcgatgtgtccggcaaggtcgacttcagcctcgtctgggcgccgctcattcgtgtgctgccgaaaacgccggtgcccgatttcgacgtgtcgcatggcgtgctggccaataccggcaacgtgcggatcggtttgctcgaggccggcgcgtgccggtccgagaaggacgatgcttcgtgccaatggacgaaattcgaccgcagtgtctatccgggccagcacttcaggctggaggggctgcattccgcaccttatgtgcgaatccgatatcgagtgggggaatggcaggtgtacagcagaaggttgtgcgcacgcattccgtcgacgcgatgaacgcgccgagcgcgaataacgagaccctgtcgggtcataccattgtttcaaccaaccagaaggactaacccatgctgaaatacgttccgatcgctgccgccgccctgatgtcgatgtcggctcacgccgtgcagaaggacatcaccgtcaccgccaacgtcgacacgacgctcgagatgctgtcggcggacgggtcggcgctgccgacgaccatgcagatgcagtatctgccgggctcgggtctccaggcggctgaaatgaacacgaagatcttcacgaacgacaaggcgaaggatctgcagatccgcctcgcggccgagccggcgctgaagaaccagacgagcccgggcgccaaggagattccgctggcggtcaagctgggcaccaccgcgctgagcaccacggcgacgacgctgaaggcgtcggagatctttaccggcgaactggcgcagggctcgaacgtgctgccgctgtcgatcggacagaagacggccggtgccatcacggctgccggcagctatcaaggcctcgtcagcgtgatcgtcacgcagagcgcggcatcgggtagctaagctcctgcgcggtatcgacgggcgcgcctgaacggcgcgccctgtttttgtagcactcctttggaaatcttccttattcccgcatgattccattcgacctcaagaagaccgttgtcgcatgcctgggcgctatctgtgtgatggacatcgtgtccgtcgcacacgccgcttcggttgtgccgcctgggttcgaggacatcgtgacggggcaggacgagcgcatcaacgtcaactttctgggtaagccgctcggcttgttccgcgtgttcgtgacgccggatgcggtgcgtttcgaggattccgcccgcctgttgcaggcgctcggctcgcagctgaacccggcgacggacgtgtcgacgatcggcgacgcgctgtcgaagtcgatggcgcgcaacggcaacctcgcctgcgcggggccggcgggcgtgaacggctgcgggtatgtcgacaccgacagcgcggccgtgatctacgacgaaagcgaaggcaacatcgagctgttcctgtcgcgcgactgggtgagagtcgaagagcgcgaccagcggtttcgcgagccgtctccgatgacggaaaacgcgcttatccatcagcagacgatcaacctgtcgggcgggcgcggctacgagagcctgtccgtgtcgggcacgggggcgctcggcatcacgccgaagagtttcatcggcgggaactggaacttcacccatacgggctattcgagaggatcggacagccacgtccagcttcaggatctctactaccgccacgatctcggcaccgagcattacgcgcaggccggccggatggacaaccgcaacctcgcgagtgcgctcggcggcaacttcgggttcacgatgctgccggtcggcacgctcgacggcatgcgtgtcggcacgacgctggcctacgtgaacccggaagttgcgcagcagggcacgccggtcacgctgctgttgccgcgtgattcgcgtatcgacgcgtaccgcgggaaggagctgctgggcacgtcttacatgaaggccggcgtcaatgcgctcgatacgtctcgctttccggaaggcacgtatccgctgacgctgcgcgtgttcgagaacggcgtgcaggtgcgcacgcagacaacgccgttcacgaagacgggcggcggtgtcgattcgcgcacacgacaatggttcgcgcaggccggccgcccgtccgaccgggacgcgccggacggcatggcagcggcagccggcgtgcggattccgctgtcgcgcgaaatggcgctgacaagcggcgtcgcgagcgtcggccggcacgtgtacaacgagacggcgctggagtggcgccatgcatttccgctgggtgtgctctccgccggcggttcgttcttcttcgggaacgacggctcgcgcggcaacacccagcagatttcgttcgccgacggcgtgtcgtggagtgtgtaccgctaccagatgcgcggcgcggcgtgcaacggcccggccgtgtcgtatcgcgacatcggttgctacgacatgctgaacgcgaccgtgtcgtttccgatgggaaactggtcggcgatgcttggctacacgtacaacaagagcgtcgggcggtcgcaggactggcagccggacacgccggatcgtccgtgggcgacacccgtctttcgccagggcgaccaggtgtcgcgtgcgcttcaggcatcgctatcgcgatccttcacatggcgcaaggtcagcacgaacctgcgcgtcggcgcgtacgcgaatcgcagcacaggtgcccgcagcgagtatggcggttacgtcggcgtgacgctgtcgatggccgaacccgcgaggcagctcgggcgcgcgtccgcttacacgtcggcgggcgtcgacgttcgaacggatcgcaacagcacgacgacgaactacacgctcgaccgcaactggaactggcagggcgacacctaccgggaagtcgcgatcggcgtgtcgggctatggcaccgagagcctgaccggtacggtccagggccgctggaaggggcgctacggcgacgtcgccgcgtcggtcgcgaacagctacagccgcgacagcggcggcaacaatccatcggtgacggcgagctattcgtcgtcgttcgcggtggcgcggcagggcgtgttcctcggcgcatccgcgtcgcagtcggatccgctcgcggggttcgccgtgcgggtcggcaagcgcgacgatgcgagcggcatggcggccgaggtgcgcagcgattcgagcgcgcggatcaaggtggggttcgggcagcgcgcgctgctgccggtgtctgccttcacgcccgtgacgaccgaagtgaacgacgcgggcgcgcaggcgtccgcgggcgcgacgagcgtgaccgaggggctcggcaagcgcacgctgttcatggtgccggggcagctcgcgttgcgcaaagtcgaagcgaaggtgacgtacacctatgtcggccaggcattctcgaagggcggcatgccgctgtcggacagtgtgatcctcaatggcgcgatgccgctgatcgacaacgaaggcggctttattgccgagcttgatcataaggaacacgagctgttcgttgtggatggtccgacgctgatgcgttgcccgctgcacgtgaagcagcagcaggacgtgctgatgatggtgggcaaggtgcgctgcgaagtggccggacccgatgcgctgccggcgtcgctgcgcaagcaggctcgcgtgcgcaagctgctggagcatcgctacgtgatgtcgatgcgggcgcaggcattggacgtaatcaacgcggcgcaatgacgcgcacgcacggatgccgcgcggcgcgacccgcgatttcgagtacacaaggaagcagtcattcaaatgattcagatcagtcgaattcgctgtcgggcaatcgtcctggcggccgcgtcgagcgcgatcgcgttcgatgcatcggcggcctcccagcagccggccaaccgcaacgatactgtggaagccacgctggatcgtggcgcgccgacggggacgtcgtggtattcaactacgcgtcgggcggctatgacacgacggatttcaagcgatgggggcggaattcgtggacgtgcgaatcggacaccgccacggcgacaggtgcgtgtccgaaagaaccggtctggatcgtggcgggcagttcgaccacgatccggcttacgttcaaggaggaaaagacgggcgccacggccgtgctggagcttcaaggagaaagtgcatacagtcgccaccgcgattgcaacggcaacgccatatcggaaggcttgtcggccgggcgaacgccaatcgagatggcgcaatccgctaccgtggcaaattgcccagccataggctgggatgggcgaaatattttcgtcaagatccccgtcgcggagctgaagaagctcccgtcgggcggaacctggaaggcgaacctgaagctgaacctgaggcaatgggacgtcggcggaaccaacccgaagatcgccactttcgtggcgtcaatcaagctggacgtcaccgacaagaacaacatccaggtttatctgccggagttcacgagcgcgacgcccacggtcgacctcaagctgcgcaagctgccgaacggcagccgaatgtcgggcacgtcgaacgtcgatatgtgcctgtacgacggctacaactcgcagagcacgtggttcgacgtgtcggcgagcgacggtttgacggtcgaccgtcgcgacaagggccagtattccgtgctgctcgcgtcggacaagagcggcgcgtacgaatcgcgtatcgactacaacgtgagcctgacgtacgcaggcaagaacatcgtgctgccgaacaacgagacggtgcggctccagggcgtgaacaacagcgccggtcgctcggtatcgctgccgggcatttcggtgccggtcgtctgcacgccgacgccactgacactcgagacaccggaattccagtcggcctggaagcgtccgggcaagtacaccaacaagctgacgatcacgtttacgccgtcgtcagccagtctctagcgcgttcggcgcccgtgaagcggcgccgagcgcctttaccccaaacgaatcgatcatggaagcaaggttctccgcgcatcgcccggtgtggcgcatgcttcgccacgtattgacgacgatgctgctgaccttctcggtcggcacgggcgccgcgaccgcctgctggaagccgatctttactgaagaggagctgcgctggatcggcgaccacccggtcgtccatatcgcggtcgaggcgaactggcacccgatcgagtacatgcgcaacggcagacacgcaggtcttgtcgcaggctatctgagcgcaatctcgaagatgaccggactcgcgttccagaccgtgccgggcaccgaatggggacacgcgtacaaggcgctcgcgtcaggcaaggtcgatttgctgccgggtgtctggcgcgagctggttccggaccgcatcggcgccggtgcgctggtcagcgcgccctacctggtcggccggcttaccgtcgtgacgcgcaacgattccgcgatgatctttggtctgcaacggctgaaggggcggcgcatcgcgatcaaggggcacggtgcggtcgagtacttcgtccgccacagtggcgtgccgctccatgtgctcacgttcgacaccgaggaactggcgcttggcgcggtcgccaacggcgaagccgatgccgcgctcggcatcgacgtcacgatcctgccgatcgtgcggcggcaattcaccgggcagctttacatgtccggcatgctggccgaccgcccggtgtcgctcgcgatgctctcgcgcgccgacctgccggtgctcgcgtcgatcatcgacaagtcgctcgcggccattccggtcagcgagacggccgagatcacgcgggactcgatcgagctgggcgactacggcaagccgacgatccgctcgatcgtgcattatcgtgcgccggtggtgctggccatcgcgttgacgttgctgacgttcgcggtgctcgcctacctgatgtggaaatcccgtgcggcggccattcgcagcaagcgcgacaaggcgatgttcctggctttcgtcagtcacgaaatccgcacgccgatgcagacggtcctgtcgtcgctcgaattcctgcagcgctcgcggcttcccgtgctgcaggccggccgcgtggaggcggccgcatcggcgtccgaaacgctgctgacgctgctcgacgacatcctcgaatattcgcgcctcgaatcgcgcaaggtgacgcttgctccgcaaacgaccgagctcgaggcgtgggctcatcaaaccgtcgacatggtgcgctggcgtgcggagcgaaaggcgctggcgctgaggctcgagatttcggggcgccgtcgttgcacgtcctgatcgatccggttcgcgtgcgccagattgcgctgaatctgctcgtcaacgcgatcaatttcacggcggccggcgccgttacgctgcgcgtccgctatctggcggcccgccacgggcgcaacggcgtgttgcacctcgaagtgcgcgacaccggcatcggtatcgcgcccgaacggttcgggcgggtcttcgacacctactggcaagccgatcgtgcgccgcaacaggggatcggcggcagcgggctcgggctcgcgatctgccgggaactcgtcgagttgatgcacggctcgatcgcggtcgaaagcacgccgcacgtcgaaacggtattcacggtgcaattgccggcgacggcagtggacggcgtgccgtcgacaccggccgtcgcggcgccgccgacactggccgacgcagcggcagcgccggtgcatcgcggcgcaccgcgtgtcctgatcgtcgacgatcacgaagccgtgcgggccgcgctgcaggatcaatgcgacgcgctcggctgtgtcggcatcgtcgccggcgcgggcgacgatgcgttgcggcatctcgcgcagggccggatcgacatggtgctgctcgattgcaatctgcccgacatcgacggttatgcactcgcgcgaatgattcgtcaggaggaaaccgcgcgaaaggccacgcatgttccgatcattgcgatttcggcggagtccggcgatgcgcacaaggcgcgttgcctggaaagcggcatggacggcgtgctgggcaagccgctgcggctcgaaacgctccggcaggcgatcgcgacgtggtgtccggccgatgcggatggcgcaccggttgcgtcgaccgcgccatagggccgcgacgcgtgccggcagccggggcccggtttacggccacgcgggccatctatgtttcggcgttgcccgaatcgtgcccgcgggcgtccgatccggccatgtcggcgcgatgcaggcgcaacagttcgtcgccgagcgcccggatgcctggcggcatggggccggatgcgaactgcagccggcgctcgagttcggctgccagttcgctcgtcgccgcatggccggcaacggcagcggcacccttgatgcggtgcgacgcatgacgcgcgcgatcggcatcgtcattcgacagcgcatcgccgagcaccgccagatccgcgtcgacgctttgccgatagatcgcccggaaatcggcttgcgccgatcgcgtttcctgcgccggtggcgcgatttcgtccgccgtgccggccggacaccacaggtcgatcatctggcgcagcgcatcgagccgcagcggcttgcccagcacgccgtccatgccgctgtcgaagcaccgctcgcgatgcgcgtcgccggtcgacgccgagatcgcgatgatgggcgtgcgcgcccgttctagcaggcgttcgctgtcgcgcatgcgtcgcacgaccgtatagccgtcgatgtcgggcaggtcgcaatcgagcagcaccatgtcgaatgccgtgcgctcgaactgcgcgagggcctgctcgccggtgcaggcaaccgccgagcggcacgcgagcgcgtcgagttgatgtgcgatcgcatgttgaaccgcttcgtgatcgtcgacgacgagaatcatcgggccgctcccggccggctgccgcgtgtcggcttcgactggcgccagtccgtgcgccggcggcgacgggtcggacgtcgtcttctgtgccccggtcgtgtcggatgcctgaatgtgagcgatgcgccgtgccggcacgatcaccgtgaagatggtgcccttgtcggggctgctgctgacggtaatcacgcctttcatcaggtcgaccagttcgcgacagatcgacagtcccaatccgctgccgccgacgcgacggttacccgaatgctcgacacgctggtagggctcgaagatgcggcgctggcgttcgggcggaatgccgatgccggtatcgcgaacctcgatcacgagcgagccggcatggtccggcttgccgtcgagatagtcgacgcgcagcgcaaccgaaccggccgacgtgaacttgatcgcattgacgagcaggttcagcacgatctgccgcgtgcgcaccgggtcgatcagcacgcacagcccgggtgggcacgcgagttcgagcgccaggctcagcttcttctcgtcgattcgccagcgcaccatgtcggcgctgcgccgcacccagggctcgacgtgcgtgggttcgggcgcgagcgtcacgttgtgcgattcgaggcgcgagtattcgaggatgtcgtcgagcagcgtcagcagcgattccgatgcggccatcgccgcgtccgcgcgaccggcctgcttcggcggcagcgccgagcgttgcagcaattccagcgacgacaggatcgtgtgcatcggcgtgcggatctcgtggctgatgaaggcgaagaacattgccttgtcgcgctcgctgcgcaccgccgcgacgcgcgagcgccaggaaacgaatgcgattgcggccagcgcgagcaggccggctccggccgcggtgacctgccagcgccggtagtaaaggatcgagtgcagcgacggcttgccatagtcggccgattcgatccattgacgtgcgatgtgctcggcgtcgcgcgccgggattgccgcgagcgacttgtcgagaatcgaggcgagcaccggcatgtcagggcgcgtggcgatcgcgagcgcgtacgggctgtccggcaggccgcccgttacgaacagcttgtcgcggtattgccgctgcagcagcggcaggatggacatgtcggggccgatggcgacgtccgcattaccgtgggagacggcctcgagcgcgtcgcgttcgtcgtcgtaggtcagcagggtcacggggatgtcgccatggcggatcgcgatttccagtgcgcccccgcccttgatcgcgacacgccggccggcgagattgcgggagtcgacgaacaggttctggcgttcggacgcaatgacgaaaacggtgccgacgaaataggggcggctgacgatgaggtcgctgcggagcaatgtggcgccgccgcccgccgtcgcaccggaggcggtgccggggccaggcatttgaagtgcatcggacgcgccgcgccaggtcacgtcgggaacgacgtcgatccggccggagcgcaatgcgtccatcgagtcgcgccaagtgacgtcgtcgacatactcgaagcgcaacccgctgatccgcgcgatggcgtcgagaaacgacggcaccacgccgacgaccttgccgttttcgcgaaattcgaacggacgccacctcgaatcgacgcgggtgtgcaccaccggatgcgcggcgatccaggccttttcctccgccgtaaaccgcggcgcgtcggccgcgtctccgggcgccggcagcaacccgatcatcatgccgatcaggacggcgcaacccttcaaactcaccatgctcacgtcctttcctcgcttgcgttatcgttcgggttgcaaccgaaccggccgcgataccggcgtggccgcggcgccgccggcccgctccggcgtcgtggttcccgtccatcgcggcgcgcggcggccgggtccgcatcggtcgccccgacgaacccgggaaccgccgaaaacgggctcgccatcataggtcgcgcgccagggaagcgcaacgccgccctgcggcggggaccaggccgaaaagcctcggccccgtttagccgacagggttaaaaattagccggaaagccggtaagctaactccaataaccgatgacatcgatggccgcttgcgacgacaagcagtaacgcacagccggctacggtcgtaccgaaataaagaaagggttagcaatgaggccaaagcaccagccgatccgggtcgtgatcctggacgaccacgccgtcgtccagcacgggatcgccagttacctgacggagaaaaccggcatcgaagtggcggcgagtttcgcgaagtcgcgcgacctgattcgctggctcgaagcgaatcacgcggatgtcgtgctgctcgactatacgctcggccccggcgagatcgacggcctcaatctcgtcaagctcgtcaatacgcgcttcccgaaatgccggatcctgatgacgtcgagcagcgatacgccggcgaccgtcaacatgacgatgcgcgcgggggcgctcggcttcttcggcaagagcgaggatctcggcgagcttgcgcatgccatccgtgtcgtcgcgggcggccgttcgtacatcagcgccgaactggccgcccggatggaatcgagcgcgacgcccgacccgcgcatggccgacacgaaggcggcgggcgacggcacgctgccgcccgaatcggcatcgtctgccgagctgcgcctcagcccgcgcgagcacgaggtgctgcgctgctttctcgccggcatgtccgtatccgacatcgcgtcgaagttctcccgcagccccaagacgatcagcgcgcagaagcaatcggcgtttcgcaagctcggcattcgtagtgatgccgaacttttcgcatcccgcaagctgatcgaggaaagccggacggtttgatcgacaggccgccgccgcgcggcatcgaatatccgcgcgttcgttgatctcggtccggatcgccccacctgccacgttgcaccccgaacgcatgatccgtcgaatgcggctaccatgaacgtcgtgttgcacgctgcggcccggccatgccggtccgtcatgcacgcacgcagtggcggtgcggccggccgccacgccaccgacgaagcgcggggtgctcaccgatcggccgttgcgcctgcctcgcttcgccccggaatcaacaacaaccgaaccggagtgcaatacacatgaaattctacaagaccctcatcgcagcaaccgtcctcgcctcgagcgtcagcgcgcacgcgcagatcgcgggtgcgcagccgatcagcgtcaccgtcgagcaatcgcaggcgctgctcgaaggctggagcgtgaagaagagcgtgctcggcaaggccgtctacaacgacgacaaccagaaggtcggcaccgtgcgcgacctgatcgtcgcgccggacggctcggtgtccgcggcgatcgtgtcggccggcggcttcctcggcgtggccgcgcacgacgtcgcggtgccgatcgcgtcgctcgacgtgcgcaagggcaacatctacctgccgggcgcgacgaaggaagcgctgaaggcgacgccggcgttccagtacgcgaaggtgccgtcgccgccgaagccgaagaaggtcgacgaaaagcactgatcgtcgattcgatgtatcgcagcccggcgcgcaccgcgccgggtccggcgaccgccgttcgtcgatggccatgcgagtcggcgcgagtcggcgggggctcggcctcgcatcatggctccgggcgaattgccccgacgatcgatgccgatgcggcggcgcatcgcgcgcgaatcggcgcggtgcgccgccacacgccgtgaatgccgcgcatgccggcgatcagatcgccggcttctcttcgtccacccacaccccgtcgaacccgaacgaaaccggcccgctcaggagcacgctgccggcgccgtcccatcgaacggtgacgtcgccgccgtcgcaggtcacccgcaccgtatcgtcgagcagcccgcgccggatgccgttgacgaccgcaccgcacgaacacgatcccgaaccgagcggcacgccgccgccgcgctcccagatgcgcaggcgaatatgcgtgcgatcgatgacctgaacgaaatgcacgttggttttctgcggaaacagcggatgcgtttcgatggcggggccgagcgccgcgacgtcgatcgtgtggagatcgtcgacgaagaacgtgcaatgcgggttgcccatgttgcaggcggccggcgcgccgggcagcggcagcgcgagggtgtcgagcgcgtcggcgaccggcacgtcccgccagccggtgagcggcgtgcccatctcgacggtgatcagtccgttcgtctcccgcgaacatacgagataaccgcggcgggtccgcagcacgagcgacgccatgccggtttcccgcatcagttgccgcgcgacgccgcgcgttgcgctgccgcaggtgtcgagcggcgagccgtcggcgttccagaacgcgacgcgggccgccgcgtcgtcgcagtccgacacgacggcaagctggttgaagccgatgcctctgtgccggtcgcccatgcgccgcacgaggtcgcggtcgatacgcggcgcgtgttcctgatcctgaccgcgcaggtcgacgatgacgaagtcgtcgccgtttgcgttcatcttctgaaatccgatcggcatggcggttccggcagggagacaggcgatcactgtacgtgactcgccgttcccgatcaatcgcatgccggaccggcggtttgcatgaatttgttcttgtcgcggctgcgttgatagggcggctgcggggtttccttcctttgcgttcctgtcgggctgcatggaggggtgccggcgatcgccgcatcgagggacggcgccaggacctcgagcgtccgttcacatgatggctttttcgttaaaaccgcctctattccaggggattcggtgatttcatccggacgacgtgctggccaccgccacgccgccgaatcccgtgcaagccgccgatcagctatacgggagcaggcaatctcggcatcggcggcggcggatcggtcaccgttccggacaaaggcgacgcgttgtcgaacggcatctcgctcggcaattgcgcgacctccacgaagccgaccatcggcttgcgcggcaaggccgcacaaccgaacgcggacaagacgctgttgtagttgagcgcgccggcagctcgcgcggtggcgcagggtttcaacctcgtgatgaccgaggcatcgaccggcgagtggattgcctgtggcgatccggtgagtgccgggcagtacccgatgaaacgcttgggcaacatggcgacgattccgctgcgcgcgcaatacatccgtagcggcgccgccgagttgacgttcacgtttccgtgagggcggctcgattcgcgggccgcgccctgcgagacgcgggtatgtcgacacaatgcgagatcacagcatgcgcttcaacacatcattcttcgacacgaagtgatgcttgagcgcggcaccggcatgcgccgccaccagggccgccagcgtgtagcaggcgatcttgtggagggcgaaccagtgctccgtcaccggccctgccgagaacggcgtcttcacgaataccgtccagaacagccagtacccttcgggcaccatcaggtagccgcttacgaggaccacggcgatgagcgcatagatcagcgaatgcaccagatgcgcgaccgcacgttgcttttccggaatcgactgaagatccggcggcgccttgcggaagaacgaccagagataccgcagcggaaacagcgcgatcaggcaggtcgcgagcgacatgttgagcgtcgacacgaagccccagatcgccggttgcgtgatgaagtgaagcgagatgccggcaaccatcgtgtagagaatgatggccgcgaagatccagtgcatcgcgcgggagagccgatcgtatcggcggacctgcggtgatcggtgccgcacgtgcggcagggaaacggaagacatgattcaacatccttgatcgggtgtcgatcggtggatcgacatgatttaaagatgagaattatcttgaccgtgccgcgcgacgtaaaagttcatgaaggatttctcaacgcgcgcggcgcctgcccgtcacggccgcgcgggccgcgttcggctgcgaacggatcaggtccgctcgagccgatacccgtagttgtagatcgtcgtgatgacgagcccgttcttcggccgcagcccgagactcctgcgcagcttgctcacgtaggtcgccagcgtcgcgtcgtatttccggtcgacgacgccccatacgtgcttgatcatcatgtccttcgacacgatccggccgacactctcgaacagcatcagcgcgagatcgaactcgcgccgggccagttcgacgggcgtgccgtccacggtggcgacgtgcgtaccggtgtcgagcgcgaatttcccgacctcgacgatcttcgcccgctgcgtttccggatagtacttccgcgcctgggcgctcacgcgcgcgatcagttcgcgttcgcgcagcggcttgacgagataatcgtcggcgccattgttgaggccgaacacgatgtcgtcctcgccgtcgtgctgcgtcatcatgatgatcggcagcgcgtcggcgaacgaatcgcgcgcccagcgcatcacgtcgatgcccgacatgccgggtacgtcccagtcgagcagcagcacgtcgacgcgcgtcgagcgtaccagttcgacgaagctctcgccgtcgtgacggacctcggtttcgtagccggccttctccagccagcgggccacgacacccgcctgcgtcacgatgtcttccaggattgcaacgatcatgttgtttccgctttcagtgtgcggctccggttgccgacgtgccggccgcgtttgcagcaccgtcgccgggcgccggcggcaggtaaacgaaaatccattcgccatacgtgtcgcggtcgccgaacgactcgtagcggaccgggaacccctggcgtttcagcggccggccggccgcttcgctgaacacgcccatgatgccgccgtccggcgccttcacgagccccatcgggtcgacccggtcagcgggtcggcatacaggcgtcgcaaatggcgctgggtcggcaaggtccggcgatcctccagcaacgcgtcgagcgactcgggatagcggttttgccccgctgcgccgtagtagcgttcgatcgccgcgcgatactggtcgccgacgaacagcagctcggcttcgcggtcgcgttgctgaacggtgctccagatgcgcgtcgcctcggtcatcccgaggccgagcgccgcgacgagcatcagcacgccgagatacgcgatgccgcgttgggtgcgcgggcgttgccgcaggttaccacgtctcatagctgcttccgtcgagcgcgtttccctttgcgccgctcttgatgtcggccacgccgccgctgtcgccggccagagggcgccacgaattgcgcttgcccgtcaccgggtcgagcggcacttcgcgcaggtagcgattttcgacgagcgcctcgagcgaggccgggtcgcggccgtggtcggcgcgataatcgtcgatcgactggcgcagcgtattcaggttgtggcgcagcacggtttccttcgcgcggtcgccctgcttcagatagccgggcgcgacgaacgcggtcagcgccgcgatgatcgccatgacgacgagcagttcgacgagcgtgaagccggcggtgcgacgcgcacgtctaccattggttgtacgggacgccattgatgccctccttgcggttggtggaacggatgtcgaacacgtcctcgcccgacgaaaaggatgccggatcgctcgcgtaactgcgcgtttcccacatctcgtcgggcgccttgccgtcgcattcgcacatcggatcggcgggaatcttgcgcaggaaatacagccgcgtgccgttcggggacgtcttgtcctcgacgccctcgaccagcgtgcgcagatccggcggatagccgctcgcgtcggcgctgtgctcgatccgtccttcgccggccgccgccttgtaggcatcgagcgccgaccggatgacgaccagcgcgcggcgcagttcggtttcgtcggcgcggcgcctggcgagatcggtcagcggcaaggcgacggtggcgagcagcgcaagcagcgtcagcgcgaccatcatctcgatcagcgtgaagccgcgcgcgcgcgcggcgccgtgcggcgctcatgcgacgctccagggctgggcagccgtccggacgcgtcggcgtgcagggtcgatccgggcacggcgccgccgttgacggacgccatgaacgacaccagcgagccgatcagcgagcgcaccatggccagcagcccgcgcttttcggtcgcggacgccgccacgtcggccggcaggtccgccgccgcgacgacggcggcctcggccttcggcggcggcacggcacgcgtggccgaggcgggctcgatcgcatgcgcgcgaggcagcggcaacgcggccgcttccgcacgcacacgcatcatgctgccgcctttcatcgtgggcctgcccgatacggccccggcgtcgcccgattcttcagccgggaggcttcagcgccctgcgcggtatcgacggcctcgtccgggcccggttgcgcggcaggcgcggcgtccgcgacgggtgccgccggttcgatcggcgcgtcgagatccgggccgttcgacgaagccgacgaagccctcggggccggcgcggccgatgcggattcgagcgtcagcgcctcggtcgtcacgcgcgtctcggtccccgacaggaacgtggtgacggccgacgtcggcaggtcgaggttgcgctcgatatgcggggtaatcagcagcacgatttccgagcgctcgttgctgcggccgttcgagccgaacaggcggccgacgacgggcaggcccgacacgccgggcagacccgagacgttctcgatctcgttgcgcttgacgaggccggcgaggatctgcgtttcgccgtttcgcgcggtcatcagggtttccgcattgcgtgtcccgagcgaataggcgacgaggccggtcttggtcgtttccttcgacaggatgctgctgacttccatgttgaccttcacgctgacctcgtcgtcgaggctgatgcgcggctccaccttcagcatcaggccgacgtcctggtagctgacggattccgtgacgacgccgttggcgttcgtggtcgtgacgatcggcacgcgttcgccgatcttgatgttggccttctccatgttgcgtacgcggatcttcggattcgcgagcgtcttggtcttgccctgcttctgcagcatgtcgatcgcgagcgacagcgcgccggattcgctggatacgccgatccggtcgcggttcaggcgcagcaggtcgccgagcgtcagcgctgcgccctccgcgccgccgagcgcgccgaactgcacgcggcccgggtactggacgccgagatcgaggctgtcgttcatgttgacctccagcacctgcacgtcgagcgtgacttcggactggggatgtccagccccatcacgacgcgctcggccacctggatcgtttcgggcgtgtcgcgcagcacgaccgcgttgacacgctcgtccacgtagatgtccttcggcttgatcatctggcgcagggccgccatcaccgatttcgcgtccgcgtgcgacaggaagaaggtgcgcagcgcgaactcggtataggtgcggcttttctcgggctgcgacgggtagacgagcagcgtgtgcttgtcgagcaccttcttctcgagctggttcgtgcgcagcagcaggttgatcgcatcctcggcggtggtgcgctcggcgaacagcgtggcgggctggttggtatcgacgtcgcggtcgaacacgaagttcacgccggacacgcgcgagatcacgtcgaagatgttcgacatcggctgctgcttgaaattgagcgaaaccggcttgcgcagcgcgtcggacagttgcgggcgcacgggacggctcgcctgcgacgcgcgcagcagcgcatcacgcagccgcttggcttccgcgtggttcggctgttcggcaaggatgcgccgcgcgatctcgagggcttcctgcggttgctcgccgcggatgcgctgtgcgcgcgacagctcgaccgccatttgctggcggcgcttgacctgctcgagttcctggcgggcgcgcagattgccggcgtcctcggccagcacgttgttcaggtgatcgatcgccgcgctgtggttgccctgcgcgttttgccggtcggcggccttcagctcggcgcgcacgtattcctgccgcgtgagttcgagggaggtggcgatccggatgtcttccggtgcggcttccttctgctgctgaagcgtgccgaggcgttcggcggatgtcccggcggcggacgggctgccggccgggaggctcgagcatcccgccagcgccagcgccgaggtcaggagcaatagactgatggttcgtttcatcatggtgttcgatagaagttcgattcgcaattcaatgggtcggcgacggcggcgacagctcgatgtccgagccgtttcgggtcatgacgaccggacctgtttcgcccagcgttttcagccggtagccgtcggcgatctcgccgcccggcaatacggcatcgcggacgccgcagcggcgtccgcacagcaggaatgtcttgccgtcgccttccagcacgacgatgcgctgcccttgcgtgcgccattcgccggcaatctcgaacggcatcggcggcgcggcggcggcgtcgatcggatcgctcagcgctggcggctccgccgcgggcggttcgacaggggcgggcgtggcgggggcgcgtcttccgcgccgagcgacacccagctttgggccgggaacacgtcgacgatgctcggctggccgacggactcgtgcgccaggctgccgcctgaggcggcaacggccagcgccgccgcgacgcgtatgaaggtgcggcgcatcatgcgtcgggccccagcaggctgacccgcagatcgacgttgacgacggggctgtcgatcttttcgcgctcgatcgtgacgctctcgatacgcaccattggctggtcggcgattttccgcatcgcttcgcgcaatccggcgtagctgccgctcagcgcgatgctgatcgtgagccgtcgcagcttgcccttcacctcggcctcgcgccggtaggtcgcgtgcttccgttccaggccgttctgcgacaggatctcgaacagcgaatacgcctgctcgcggctgcgcgctgctggacgtcgtgcagcgtcatgccgccgtcgccggccttcgggccgggcttgggcagcgcggccagatccttggcgagcgcgccgcgcgtcgcgtcgagtcgcgcgccgcccggttggatataaagcgcgtgcaggccgagcagggcgacgaccgcgccggccgccagcagcccgggcacgccgagcttgcgggtcgcgacatagcgccccagcgcaaccgcgcagcaagcgccgttttgtcgattgcattcaggtgggtcatggatgttcgatgctcaggctgaagtgaaaaatggccttgccgtcctcggtcttcatccgatgctggagcaggccgatcatgcggtccggatggcggtcgtgcaggcggtcgacgaacaggtagacgtgcgacagctccgcggcaccgccttcgatgcgcgcctcgcggcccgccttgtccaccgtcagcgacttcagcgcgatctgtggggtccaggcgtgctcgatccagtcgatcaccgacaggccggagcccttgtcggtcatcgtctgttcggccagcacgcgctcgatgcgccgctgctcgggcgtcttggccttctcccgccgctgttcgcgctcgatgacgcgctgacgctgctcgatgcgcttctcgacctgctcgacatcgtcacgcagtgcttcgacgcggttccattcgctgccggcgaagagcccggcagccagcgcgcagcacagcgcgatgccggcccacggcgtcaggcgcgtgcgcggcgcggcgaagttcagttccgacaggcgcttcatgccggatcctccgccgcgacatccatcggttcggccgtgcggccatccgtcggcgcgcacgccgcgtcgccatcggcgaacatcgaaccgtcgaaccggcaggcatgcgcgtcgccgccggccggctgcccggcgatcagcgccgccgcggcgaaccagtcgtcggggcggtcgccggcgcgcggcaacgtgacgatgtcggcccattcgcccgaacgccggaaaatgcacgtcacgacatgcggctggcgaagcgcgaagcggaaatcgtcgccgaccagccgcgcggcgtgcgaggcgagcgacgccgacagcgcgtcgcggaagctggcgagccgccagccggccgcgcggctcgcgtcgacgagcgccgcgaggagttcgtcgcaggccgcggccgcgaggcgcgcgcgccgcgccgttcgtcctcgatgaggatgcgcaacgcgccgcgctgcgcgcgcggcgaacagcatgcgggcatacgcatcccacgcggcgtccgacaccaggccttcctgccagggcagcaccacaccgtgcgaccacggatgcccgacgacgacgtggaggcggttgcgcatcggcaggcgcgctttcggcaggccggcgagcacctgcgcgagcgcgtcggccggccggccctcgtgggcgacgacggcgagcggtgcaccggtgcgccgtgcgcgccggctttcatgcgcccggacgtgcagcgtatcggcgtcgatcagcacggtgacgtcattccagagcgattgcacgctgcacctcctggaatgtcgtcattcgtgcgcgcaccgccgccagccccgcgtcgcgcatcgactggtagtcggggtgctccgcgagtgcgcgcgcgcgcttctcgatcgagcgctcgagcagggccgccttcagcggcgcatccagcgcaagcacttcggcaagcccgatccggccgtgatagcccgtgccgcggcacgtgtcgcagccggcgccggctgccacctcgcgccgaagcacgtcgggcggcgcatcggccaggtccgcgccgctcgtcgccggagcgccgcaggtcgcgcagatccgccgcaccagtcgctgcgatacgacgccgttgagcgcctcgagaaaggtcgacggttccacgcccatgtagatgaagcggtcgatcacgctgaagccgtcgttcgcgtgcacggtcgacagcacgcggtggccggtgagtgccgactgcaccgcgatcgacgcggtttcctcgtcgcggatctcgccgaccatcaccgtgtccggatcgtgccgcaggatcgaacgcagcccgcgcgcgaaggtgaggcccttgcgctcgttgaccggaatctgcagcacgcccttcagctcgtattcgaccggatcctcgatcgtgatgatcttgtcgtcgcccgtgttcacctccgacagcacggcataaagcgtcgtcgacttgccgcttccggtcggccccgtcacgagcatgagcccgtaggggcgatgggcgagcgcacgcacgcggcgggcggtcgacgcgtcgaagccgagcacgtcgaggctcacgctgtcgccgcgttgcgacttgtcgagcacgcgcatcactgcgttctcgccgtaggtgccggggatgatggagacgcggaaatcgatttctcgcccctgcatcacgatcttgaagcggccgtcctgcggcacgcgtttttccgcgatgtcgagggccgcgagcaccttgagccgcgacatcgtctgcgtggcgacttcgatgccgggaatgtggcggatcgactgcaggacgccgtcgatccggtagcggatcgacaggccgtccgccgccgattcgaggtgaatgtcgctcgcgcggctctgcagcgcgtcgtacagcgtcgagttgaccagccggatgatcgggctttcgtcccgggcgatgctggcgagcgaaatcgattcggtcacgcgcgcgagcgtgtcgcccgatgcgtcgatcgtcacgtcgtccatcgcgcgttcgttcgattcgagatcgccgagcaggcgctcgacttcgccgggagtgctcatcgcgagactgaccggccgcgcgccgacgcgcgagagcagttcgtcgcgcacgctgcgcgcgaccggatcggcgacgacgatgcacggtgcaccgttgcgcttgatcggcagcgcgcgccagcgcgtcgtgcagcggcaacaggtcgaaatgcgtcggcgcggcgcgcagcgtgtcggcgtcgatcggatcgatgccgaggcaggccgccacttcggcgagacgcgtcgcgtcggcgcgcatcaggtcgttgacatactcggcgaaaccgatgccggacgcctcgctttccgcgtgccagcgttgaatcaggtgttgcgtagtcatcttgaattctccagttgggaagcgggaaggcgggcatctggccggccgggaccgctatccgacgctgccggccaattcgaagatcggcatgtacagcagcagaaccaccgcgccgaccgttgcgccgaccgcgagcatcagcaccggttcgaaaaccttgctgatcatttcgatcgaccggtcgagcgcgccgtcgtggaactgcgcgatgtgttcgcacattccgcccaggtcgccgctctgttcgccgacgcgcagcagccgctcggcgacggaggtcgtcagtgcatgggccgcgaagacggtcgataccgatcgtccggcacgcaactcggtcagcgcggccgcgaggcgcgccccgaaatgcgcgggcagcaccttgccggacaattccagcgcgtcgatcacgggcgtgccgcccgcgatcaggagtccgacggttcgatagaaccgggtcagggcgaacagcgcacaaacgtcgcgcaccttcggcgcccgccacatcagccgctgcgccgcgcgcttcgcggcggccgagcgcaccgccagccccgcgccgacggccgccgcggcgaccgccatgccgaccgccgcgccgttctcgcgcaacagggtcgcccaccagagcatcacctgcgcggtcggcggcagcgtggtcagcgactcgaacaccaccgcgaaacgcggaatcacgaaaaaggccatgaacagcaggatcgcgatgccgacgccgatcacgaccgccggataaatcagcgcgccggtgacccgcttgcggatctgctcgatccgcacttcgtattgctggtagcgcttcagtacggcgggcaactggccgctgtcttccgacgacgcgatcgtcgcgacgagcagccccggaaagacgtcgggctgtcgcgcaagcgccgcggataacggctgcccttggtacatcaccgacaggatccggtcgatcacctgcttcgacgccttgccggcatcgttcttgtcgcgcagcgcctcgagcgcttcgatcagcacgaggcccgcatcgagcagcgtcgacagttcctggaggaacagcgcgagcgcaaatttcggtgcgcgcttgcgtctggcgaggcgtgcgcggcgaatgtcgagcgcgacaccgccttgcgccgcgatccgggcccgcacgtccgcttcgctcgctgcttcgatcgtctgcagggcgaccttgccgtcggcaagcacccgaacctgaaacgattgcatggctacctccgccattcgtcgagcaacgccgagctggcgacgcgattgctggtcagcgtctggtactcgcgccagaccttggtcgcatacgatttgcgcaccggttcgcgcttcgccgacgatccggcgttgtaggcgccgacggcattccatgtgtagccgtgccgttcgatgaagccggcgagaatcgatgcgccggtgtcgatcgacgtacagggctcgttgatcaggcgcccgtgcgtgacgcctgtcttgatcaatcgcggcaggtgcgagctgttgatctgcatcagcccgatgtcgtaggtgccgttgcggttgtaattgatcgcgcgaggattcagcgacgattccactttcgcgatcgcgacgagcaggagcggatcgataccgtgccgctcgcctgcctgggtaaagcaatccttggctgcggcgccggacgcgcagacggcgatcgccgccgcgacggtccagcgacgcaggcccttacatgccgtagacgaggtccgcatcgttgccgctccctccgacacgaccgtcccgaccgagcgacacgatctccgcctcgccgtctcggcccggcacgttccactgataggcccgaccccagccgtccttcggcacggccttcgcgagataggggccgttccacccgtcggtgttctgcggctgcttgaccagcgcatcgagcccttcgtcggcgctcggatagcggcccgtgtcgagcctgaattgcgtgaccgcgtcgccgagcgtcttcatctgagattcggtcgagcggaccttcgccttgtcgacctgcgaaaagagtttcgggccgacatagcctgccagcagcgcgatgatcagcagcaccaccagcaattcgagcaaggtgaagccacgctggcctcgcttcttcgtccatttcggatagttcgatttcacgttgtatgccctcggtttaagttccgacgcgattcgcgggtcggagtgtcgtcgtattgcggacgactgatgaatggcgcgctgtggggaagggggcttgttcgggcccgggcgccgtttgataacgtcattttgcaaacgcgatgcaggcgccgcaattttcatgaaggatgtctcaacaaacttcgaaacacgccgcgcatgcacccgtcgaggacgggcgagccgcacgccgttggcgcgcggctcgcgggattcatacgggaatccttacttgctgcatgcgccgagatccttccagaccttgccggtgtgatcggcgccggtcgtcgcgggcgagcccggcacgtcgttctgggtccaccagcgcgcctcgtaggtgcggccgttgtgctgcaccttcgcgccgcccgtataggccgtgccctgcttccacgcggcctggcactgcgcgccttcgccgccgcccgtgccgccggtcagcttgaacgtgacggtttcctgcttcagcgtgccgccttcgatctgcgacgtcgccacggccgtgtgcgcgccggccttcgcattcgcgatgtcgacgctcaggtcgccctgcatccgcatcgttgccgacttcgagccgaccagcgaattggccgcgtcgtacaccttcatcgtgacgctggtgtccttcgcgtgattgaacttcaggaagaacttcgcggtggccttgccgttctcgatcttgaattccgggttgctcgtgacgctgaaaccttcgtcgatgcccgattccggcttcttctcgaccgtcgtctccgtgcgcacgatgccgctgccgctcttggcgaacacgttgttcgcgcccagccccggctcgatgcgcccgtcgcgctcgatgcctgccagcaggctggccgactgcacgcggttgatttccttcgcgagcagcatcggccacatgttgcgttcgccctgttcggccgtgccgatcgtgacggtcgtcttcatcgacggcacttcgccgcccgacttgaacacgcggttcatgaccttgtcgccggccttcaggtcgacggtcggcgcgatggtgccgacggacgaccagctcggcttgcccgggtcggtcggaccgccgtccgccttgatgttgaggtcggccacgttgtagaacatgccggccgtgtcgccgacgtgccacgtgctcagcatcacgtgatggccggtgcggtccgacggaatcgtgcagttgtgcggcccgatcgcgtcggccttctgcatgccgccgtcgaccgtgcagaacggcgtcaggtcgaactggtcgcgcgtcagcggcaggttcgggttccagccctgcttcgtcaggtagtacttgaagttcttcgtcacgtgcggcgcggtgaacgtccacttgaactgctgcgcgcccggcttgatgtcgttggttttccagcggtcgacggattgctcgttcagttcgctgaactgcacgacgccgccgcttgcgatctgtccgtcgggcgcaccggcctgagggaagccctgcttgccttcgacgctttgcggctcccatgtgaccgagccgcagttgaagttttgcgccgggccctgcttcgagctgcacatcaggttgcgcgacggcgggtcggagaggtagccgtgcgcgaacgcatgttgcgcgaagaacatggatgcgcatgcgaccagcggcgaaagtttgaagagcgttcggctcgcggtgtgtttgttcatggtgtgtaggagatggatcgtatctgtcggtactgctttcgaaagagcggttgatcgaagccggcacggtgcccggcgtttgcgcgtcgtgcatcgggtgggatgcgacacgggttgcagtttccgcgagcgcggcgggggcgagaatcttcctgaacgattcatcaagaatccggctgccggtttccgaaaaaccggcatttcttgagacatccttgagattgattggcgcggggcggcggggaaaaacaatgcgacggtcgattcagacactctttcaatttctcaaggatgacgatcaaattgcgcctgaataaactcaacctcaatccgtcgcgtatcggcgttgcatccggccgcacccagacgcttgcattcgcgacgatcgccacggccagcgcgctgtgtttcgcgaacgccgcgttcgccgcccccggcaagcccagtctcaagcaatacgaaatcacgtcgaagccgcacggtttcgtcgagatcgatctgcagagagcgggcagcgcgccctacaaggacctcgtcaagctcaacaagaaggtcgacgtgccgctgccgttcgacatctggagcaacgggacggccgtgaaggcggtcgcggtggtcgacggcgcggtcgatgccgcgtcggaactcaagctgacgcccggcggcacccagagcggcaccgtcatcgccaacgtcaagacgccgggcgtgaagaagatgcaggtccgggtgatcgacgcgaacggcgcgtcgacggacagcgcgccgatcgacgtggtcgtgttcgacacgattccggaactggccgatacgctgcccgacaacgcgagcaaggcgcacaagcgtttcaagaacacgtccggctcggtggtcggcacctacttcgcgacgtggtcggtctacgaccgcaagttcaacgtcgacaacgtgccggtcgagaacctcacgcacatgctgtatggcttcgtgccgatctgcggcggagcgaacatcaacgcgtcgctcgcgcgcgacgtgccgaattcgttccgcgcactgcagcagacgtgcgcggggctgcccgacttcagcgtggcgatccacgatacgtggggcgagatgggcatgacgctgcccggccagaccgcgaactcgaagctcaagggcgtgcttggccagatgatggccgcgaagaaacgcaatccggacctcaagatcctgccgtcgatcggcggctggacgctgtccgatccgttcttccagctgcacgacccggccaagcgcaaggtgttcgtcgattcgaccgagcagttgctgcgcacctggaagttcttcgacggcgtcgacatcgactgggaattcccgggcggcaagggcgcgaacggcgcgatcggcaatccgcagacggacggcgcgctgtatgtgacgctgatgaaggaactgcggcagatgctcgaccgcgtgtcggcggacaccggcaagacctacgagctgacgtcggcgatcggcgcgggcaaggacaagatcgacgtggtgaactacaaggaagccacgaagtacatggactacatcttcgacatgacgtacgactactacggtgcgttcagcctgacggagctgggtcaccagacggcactgcacgcgcccgcgtggcgaccggacaccaagtacacgaccgacaactcgatcaaggcgctgcttgcgcagggcgtcgatccgaagaagctcgtcgtcggcgcggcggcatacgcccgcggctggaccggcgtatcgggctacaccgacggcaatccgttcaccggcaccgcgaaggggccgcacaaggggcagtgggaagccggcattctcgactacaagaagctcaaggcggagatgatcggcgcgaacaacgcgggcatcaacggctacgaataccactacgaccagacggccgaggcgccgtacgtgttcaacaagagcaccggtgaactcctcacgttcgacgacccgcgctcggtgaacgccaagggcgactacgtgcgcaagcagcagctcggcggcatgttctcgtgggaaatcgacgcggacaacggcgacatcctgaacgcgatgcacgaaggtctcggccacggcgacggcggaagcggcgcggagaatcgtccgccgatcgcgaacgcgggggcggccatgacggtcaccgggccgcagacggtgacgctcgacgcgtcgaagtcgcgcgatcccgacggcgacaagctgaccttcaagtgggaacagatcggcggcgatccgctgaagatcggcagtccggacagtgcgaaggcgacggtcgacgtgccggcggtcaagcaggacacccgctacacgttccgcgtgacggtgaccgacccggccgggctgaagagtgccgcgcaggtcgtcgtgaccgcgcaggccgaagcgtcggtcgagccgccgccggccgaaaaccgtccgccggtcgcgcgactcagcggcccggcgcaggcggaaggcggtcaggccgtggccctgtcggccgagaaatcgaccgatccggacggcgacaaactgacgttccagtggacggctccgtccggcatcgacgtgcagccttctggcgcgacgctgcgcttcaccgcgccgaagcttgcgaaggaccagtcgttcacgttctcggtcaaggtcggcgacggcaagctgtcgtccaccgctcagcacacggtgctcgtgaaggcgacggagacgggcggcggcaatggcggtggcggcaacggtggtggtggcaacggcggcggtggcgaaggcggccagtacccggcctacaaggccgggacgcagtacaaggccggcgacgtcgtgtcgaacctgggcaagctgtaccagtgcaagccgttcccgtacagcggctggtgctcgggtgcgccggcggcctacgaaccgggcaagggcttcgcgtggagcgatgcgtggacgatcttcggcaacggtgaaggcggcggtaacggcggtaacggcggtaacggcggcaatggcggcaatggcggcaacggcggcaacggcggcggcgaaagcggcggcaaccatccgcagtacaaggaaggcaccaagtacggcgccggcgacatcgtgtcgaacaacggcaagctgtaccgttgcaagccgttcccgtacaccaactggtgctcgatggctgcctgggcctacgagcccggcaagggcaccgcgtgggatcaggcctgggaggaacacaaggactgacgcccgctcccggttacgccggcccgcgctgcatgcccgggccggcgtcgaacctgtatcctcgaaccggcatcgaccgatgccggcccggccctcgcctcgtgcggggtttttgtttccggcggccgccgggccgctatgcggcgtcgtccgtgcccgcgcgggtcatcggcaagtgcacggtgaagcggctgccttgccgtggcgcggacgtcacgtcgatcgatccgccgtggcgctcgacgaccgtcttgacgaacggcagcccgagcccgacgccgccgcttgcatcgcgatacgtgccgtccacctggaagaacggctcgaacagccgcggcatcgcctcggccgggatgccgatgccgttgtccgccactgcgatggagacgtggcgctcgtcggaggtgatccatacgtcgacgaccgtgccttcgtccgaatacttgatggcgttgtcgagcaggttggtcagcgcgcggagcagcatgtcgcgattgccgagcacgaacgcttcgttgccgtcttcatgcggtccgtcgacgcgaatccgcttcgcgcccgcactgtgccagacctgatcgaccgcttccatcgccaggtcgctcgcggacaccggtatgtaggcgccctggtcgagatgctccgcgcgcgagagctgggtgaaatcctgcgcgacgcgcaggctgtagtcgacgagcttgtgcaggtccgcgaggaaatcgggatcggtcgaaccgtcggcggcgctgtgctgctcgagcagcgacagcacggtcgagagcggattgcgaagatcgtgcgccatgtggcgcagtgtcatgcggtcgctttcgaccgccgccgtgatgttgtggatgtcgacgaggcagatcatgctggccgtggagcgatgacgatcgccgtcgccgaacggcgtcaccatcatcatgtgcgtgcgcgcgttcagcgtgagttcggccgagtggatccgcccggttttcttcgcggcgaggattttgtcgtaggcgatgccgatcacctgccgggcggccgcatcgctgtcgacgtcgatcgatttcagcatcgcgttgccgcgttcgttgcacatcagcaggctgccgtcctgttcgacgaagatgggataaggcagcgtatggatcacgtcgacgtaggtcgactgccattcgcggatgcgcgacatcgcctgcgcgacgtcgtcgtccgtcggcgccgcatcgtcggcgtcgcccgtttgcgcaaggcccgcgaacgtgtgccggcccgccagcccgcgcaacccgcggtattccttcatcagcgcggcgcgcaggctgcctgcgcgccgccagccgcagacggcgaagatcgtcacgcacacggcaagcgacggcccgaccggtgtccagtatgcgccgtacacgagcagcgccgtttcgccggcgacgtaggcagccagccacgccagcgcgaatccgtacatgcgtcggcccggcacgagcaagcagatcagcagcatgccgatcgcgaccgccatgctgacgaccagctggatcccggccggcacgcgccgcatcaggtgcccgtcgagcaacgcttcggtggcgagcgcatcgacctcgacacgcttcacccttccgccgcttctcgtcgacagatagaacacgcccgtcatctcggacatcccgtcgccgatgaacacgatgcggtcgcgccatgccgacgcgggcacgcggcccttcagcacgtcgacgaacgagtagctcgcgaggtcgaagcgcaacggaaggcccagcaggatcgtgccgtcttcgactcttcccatccgggtgacatgcggctgcacgtggcgacgcacgtcgctgtccggcagcggcacgttggcgacgcggatcgcctgcaggccgacatggggatttcgtcgccgctgctgcttttgacatagggcacgatgccctgcaccagatggtcgctgcccagcacgatgctgcgctggccgatcgccgcggccgcttcccgcagcgaccgcgccggcaggatcacggtatcggcccggtcgtgaaccggcgacatctgggcgggcaagaccacgcggccgtgcctcgcgatcgcggccgccagcaccccgtcgtcctgcgccggcgagatcatcgtcatgtcgaggacgacgctcgatgcgccggcgacgcgatccagcaccccgcataggccgtgcgcgtgtagctcccgctgccgcccagttcggcgagcgtcttcttgtcgaccatgatcaccgcgaccttgtcgcgcggcccgcgatcgatgccggatgaaacggcgtgccagtagagtcgatccacgggcgagagcagcgtctcgacggcggcggtgcagctcagtgccgcaagcgcggcgacgccggtcagcagcagccatgtggacgggcgtgccgacgctgcgattcccggaacctggcggagcctgtcgagcatagggcggcgtttcctcgaacaagatgttgttggatgtcgaccgggatgctgcagcgccgggcgccccgggcaaacgatgctcgccggttcgcgccatgcgggttttcccgtcgggagagtctagcgttgtttgcgccgttcgggagcaggcggcggggcgaaatcgctccgaacgaaaccggcggcgccgggcggcgcgttgagaatgggttgaggatgtttgagcggggagcggggcgtcgcaacaatgcggattcctttccattcgcgccgtttgcgccttgccattccatgatcgtgaagaacctcagccatgccttcgcactgacagcgctgtccgcggccgtcgcggccatcctggtaccgtccggcgcatccgccgctcccgcgtacgcgccgatcaagcactaccaggacggtgtcgagcaatgcctcgcgtggcagccgggcagcgccgatcccgtcgtcgcggcctgcgacggcaccgccgcgcaggactgggcgttcgtgccgggcgcggggtattaccagatccgcaatgccggggccacgcaggcgcgcggccaggacatgtgcctgcgcacccgggccggcaataccggcatgggcggcgtgtcgatcgacgcgtgcgccggcggcgacgcgaagatgtcccagtggcgcttcgagacggggccggccggccgtcttggcatgctgaacgcgcaccggatctcgacggggcgagacgaagtgctcgcgatccgggccgggacccagggcgtcgcgatgcagttcgcccgcggcgaggcatcggcggcgtgggtgtcggcggcgacgtttgcgccgccgcagcgtccgctggtgggcaacaggacggcgctggtattgaccgcgcacttcggcaacgccgcggcgaacgatcccggatcatccgcaaggccgtgttcggcgacggcgacgactattcgtcgctgcgccgctatatcgaagtggcgtcccacggcaaggccacgctgggcgggaccgtgctcggcgacgtcgacctgggcgcccgcccggcgacctgcagctcgggtgcgttgctcgactcggcccgcaaggccgcgctggcgcagggcaccgatccggcgcgattcgactacctgctcgtcgatttctcgaaactcggcagctgcggctgggcggggctggcggcgcagccgggcaactggatcctgtcgaacggcaatggccacggatactggatgtggacacacgaattcggtcattcgctcggcgcgtcccaccccgattcgctgatcgactgcccgaccgtcggcggcacggtgcaggtgggtgccgcgtgccgcacgggcaaggtcgacgatccgtccgacaccgtcggcggcggcggccgtcgcctttatcccggcagctaccagctgttctccggctggctcgatcaagcccaggtgccggaaattcgcgagtccggcacctacaggctgatgccgctgttcggcgaccaggcgggtgcgaaaggctatcgcatcgcgcgcagcgacggcacgcagctgtggctcgaattccggcagccgctgcggagtttcgacgactggaaggcggacgatccgttcgtcaacggcgtgatcgtgaggaccgtccggtatcagggcagctcgctgaagaatacgctcgtggatacgacgcccggcagcgccggcggcatgaaggatgccccgctgatgccgggtcacgcgctgcacgacacgctgtccggcaagatcgtcacggtgaactcggtcgggccggacggcgccgtggtcaccgtgaagaacgacggcgtgctgctgccggaggccgccatcacggggcccgcgcaagccgatgcgaacacaacggtcacgttgtccggcgacgcatcggtcggcgatcgcctgcgataccgatggagcgcgccggtcggcgtcgcgctggagcaggacggcagccgtgcgagcgtggtcgtcccgccggccgaccgggatcgcgagtacgcgttcgggctgaccgtgatcaacggtaacgggtatgcggccagcacgacgcacgtgctcaaggtgaaggcgcaggaggcgattgcgccgccgggcgcgtcgatcgccggcccgacacgggccgtgggcggcgaacgcgtcacgttgtcgagcgcgcaatcgaccgggaagggcctgtcgtacgcgtggacgagcccgcccggcgtgcagctcagccagcagggagcgacggcgagcttcgtcgcgccgaaggccgggagcgagcgcggatatgacttccgcgtgacggtgaccgatgtgcagaaccgccagtccgtggccacgcaccgtgtgacggtccaggccgatgccggcgaggcggtcgagtcatgggacccgaagcggacctacgccgccccttgccagaaggtcgcttacgccggcaagcgctggatgaacggctggtgggtgctgggcgacgtgcccggccagggcggcgaatggggcccgtggcgcgaattcggggtggccaacatgcatgcgcagtgcaaggtcaaatgatcgagggcgcgcgccggacgggcagcgaagcacccgtccggctgccgcgcgcgcgatggccggaataccggcatcggccggtggtgcgcctgctcgcggccccattgcgcacggcgaggtgccggtttcctcgctcctgggcagcaaaccgggcgcagcgatcaatgcctgccgcagtctcgcgcacggtccggccggaacgcatttctacgtaattctacgtagctccgcgtacgtagttaaccgcttgtaagcctccccggtcacacggaatactacggcccatcgccgcggcctttgcgagaccgcggcacgacgcatcgacgtcacgcgggttcggcgcctcgccgcatccactcaaaaacacattggagaccaggagacgccatgaatcgggcttccagtaccctgctctggattgcggtcgcgctgctcggcgcgttcgcgttcggcacgatcgcactcgcacacggcgagcgcgtcagtgccctctggatcgtgatcgccgcagtctgcgtgtatctgatcgcgtatcgcttctacagccgtttcatcgccagcaaggtcatgcagctcgacgggctgcggatgacgccggccgtcaagtacaacgacggcctagactacgtgccgaccaacaagtacgtgctgttcggccatcacttcgccgcgatcgccggcgccggcccgctcgtcgggcccgtgctcgccgcgcagatgggctacacgcccggcatgctgtggatcctggccggcgtcgtgttcgccggcgcggtgcaggacttcatcgtgctgttcatctcgacacgccgcgacggccgttcgctcggcgacctcgtcaagatggagctcggcacggtgcccggcgtgatcgcgctgttcggcgcgttcctgatcatggtgatcatcctcgcggtgctcgcgctgatcgtcgtgaaggcgctgaccaattcgccgtggggcacgttcaccgtcgccgcgacgattccgatcgcgctgttcatgggcgtctacacgcgctacatccgtccgggccgcatcggcgaagtgtcgatcatcggcttcgtgctgctgatggcgtcgatcgcgttcggccagcacgtgcacgattcgccgacgctcgccgcgtggttcacgttcaccggcacgcagctcacgtggatcctgatcggctacggcttcgtcgcatcggtgctgccggtgtggctgctgctcgcgccgcgcgactacctgtcgacgttcctgaagatcggcacgatcctcggcctcgcgatcggcatcctcgtcgtcgcgccggaactgaagatgcccgcgctgacgaagttcgtcgacggcacgggcccggtgtggtcgggcaacctgttcccgttcctgttcatcacgatcgcgtgcggcgccgtgtcgggcttccatgcgctgatctcgtcgggcacgacgccgaagctgatcgacaacgaaaccaacgcgcgcttcatcggttacggcgcgatgctgatggaatcgttcgtcgcgatcatggcgctggttgccgcgtgcgtgatcgagccgggcatctacttcgcgatgaacgcaccggcggccgtgctcggctcgacgccggaagcggtggccaacacggtcacgcagtggggcttcgtgctgacgccggacatgctgacgcagaccgcgaaggccgtcggcgaaacgacgatcatcgcgcgcgcgggcggcgcgccgacgctggccgtcggcatggcgcacatcctgcaccaggtgatcggcggcgaagcgatgatggcgttctggtatcacttcgcaatcctgttcgaggcgctgttcatcctgacggccgtcgacgccggcacgcgtgcgggccgcttcatgctgcaggacctgctcggcacgttccacccggcgctcaagcgcaccgagtcgctgcccgcgaacctggtcgccaccgcgctgtgcgtggccgcgtggggctacttcctgtatcagggcgtggtcgatccgctcggcggcatcaacacgctgtggccgctgttcggcatctcgaaccagatgctggccgcgatcgcgctggtgctcggcaccgtcgtgctgttcaagatgaagcgcgagcgttatgcgtgggtgacgatcgtgccgaccgcgtggctgctgatctgcacgctgaccgccggctggcagaagattttcgacgcgaacccgaaggtcagcttcctcgcgcacgccgcgaagctgcaggccgcggtggacgaaggcaaggtgctcgcgccggcgaagtcgatcgcgcagatgaagcggatcatcttcaacgactacatcgatgcggcgctggccgggctgttcatcttcgtcgtcgtggcgatcgcggtgtacggcgtgctcgccgtgctgcgcgcgcgccgcgagtcgaagccgaccgtgcgcgagacgccgtacgaagcgatgccggccgcgcaggcgctcggcagcggacgttaagggaggccgcgatgttcagcgatcttggcagcgacctgcgcagcgcggggcgttacctcgggcaggcgttgcggctgatggtcggcctgcccgactacgacacctacgtcgcgcacatgcgcgagacccatccggaccgcgagccgatgacgtacgaggaattcttccgcgagcgtcagaatgcgcggtacgggtcgggagcagggaagtgctgttgagcggttgaaacggcaggaaagaacgaaaggcgtcatggcgtgaaagccatgacgcctttttcatgccgacgcaaggcgatcggctcgtgcaacgcatgtcgtcgcgtgcggccgtcagtcgtcgtgacggagcgcaagcaccgcggcggcccccgctgcgagcgcgatcagcgtcaaggcgacgccgaaaccggtcgcgcctgccgtgaagccgacgcggtcgatcgcgtacccggtcatcacgggcatcagtcccgccggaaggtagccgccgatgttcatgacggcgttcgcctcggcgcgccgcgcgtccggtacgtgcaggccgatcagcgtcaggccgccgagctgcccgaggccttgtcccgcgcccgcgaagagcgccgccgcgacgaggacggcggccgacgacgcatgcacggcgatgcacagcatcaccatcgacagcatggtggcgaccgtgccggcaacgaacgtcgtacggatcgatccgcgccgcgcgacgacctggacaccggtagcggcgatgaacatcgcgcaggccattccgcccgcgagcagcgggctgcgcatgtgaagcaggcgtgccagcaacgacggacccaacgcaagcacgaaggaggtcgcggtgatgcccggcccgaacacggcgacaccgccggcgacatggcgccggttgtgaaccggcacggacggcagacgtagcggcggcgcgtcgcctggcgcctgcgcgggccggttgcgcggcagccgcagggcgacggccaacgcgctcagcaggatcacgaactcgacgccgaagacgagggcgaccggatgcgcggcggtttgcgcggcaatcccggcgagcaacggcccgagccccgcgccgagcaccatggcgaccgacgcgagcagcgcggccttgcgccgctcggtgcccgcgagatcgatcaccgacgccatgcccgccgacacgatcacgccgaccgcgatgcccgtcagcaagcgggcgaccgcgagcatggcgacggacgacgcggtcgcgaacaacgcgcacgcgatcagcgccgcggcgaggccgggcagcaggaccggcttgcgcccgtaacggtccgaaagctggccggcgacgagcagcgtacccagcaggccggcgatgtagagcgcgaagatgacggtcagcgtgccggacgagaaaccgagtgcgtgctgccaggacacgtacagcggcgtcggcgagttggacagcatgaacacggcggtgaccatccaggcggcgtgtgccatgcggggcacggaacgcgagcccgcgggtcgcgattgagggacggcggtgtcggacatgaacgcattccttgtacgagtttttcgaactatagcttagttcgaaaaactcgtacagggtgatatgcttgccgacatgaaacgaacccaccctgaacgggcggccggcctcgcgccggcgcctgcggatttgcccgatccgctgccggagccggacgtcgccgagctgcggctcgaaaccattcttggcgcgctggccgatccgttgcgactgacgatcgtgcggaaactgatgctggaatccgaggcttacgaccatccttgcggctggttcggcttcgatcgcccgaaatcgtcgctcacccatcacttcaaggcgttgcgcgacgcgggcgtgctgcgccagcgtcaatacgggctcgagcggcgtagccgcgtgcgtacggaagatctcgatctgcgctttcccggcctgctgaagctcgtggccgagtgggcgccgccggcagacagcgacggttgacggctggcggagggggatggtggatgagccgcccggcggggcgcgccggttcgccaagcggcggcgagcgtgacgcaccgggcgcgctgcgccgcggagccgtccgtgtgccgggtttgatctgcctgcaacccggcttcgtttcccggccggtatcatgtgaaccattcaccccgatgaacccgcacaggaggagcccgtcgtgcatgccggtgagcgtttcaacagcattacccatctcgtcggcgcggtgctatcggtggcagggctggtaacactggtgacgatgggtgcgctcgaaggcgacgcctacaaggtggtgagcttcagcgtatacggcgcgatgctctgcgtgctctatgcgatctcgacgctgtaccacagcgtgcgtagcccgcgcctgaaagccatcctgcagaagtgcgaccactcggcgatctacctgctgatcgccggcagctatacgccgttcacgctggtcacgctgcgcggcccgtggggctggtcgctgttcggcgtgagctggggctggccgtgttcgggatcgtccaggaactgacgctcgggcggcgcacgcgcatgctgtcgatgatcctgtacgtggcgatgggctggctcgcgctcgtcgcggtgcgtccgctgatccacgcgctgccgccggtcggcaccgcgtggctcgtggccggcggcctgatctacagcgcgggtatctacttcttcatcaacgacgaacgcatccgccacgggcacggcatctggcatctgttcgtgctggccggcagcctgtgccagttcgtcagtgtcgcgatgtacgttgcgtgagcggaaggcggcgtcagccgccgccggcgccgaatcgaccgcttgctgatcggcgatcgcaccggcactcgaggtcgtcgtgttcgcaacgcggaagtcgacgtatcgcgatgaatccggggcgcgcccaggaagatccgccggcgcgcggcgctgttcgtcgtgacacgctgtcgcgtcgggcgagtgaactactcgccttccgcgacacgaatcccggccgtgtgagcgccgactttcggcgctttgcctgtccttgtcgcgatccaccacatcggcatcgcagacgcggatattgccgcggcggccagcaacgccacccgcatcgccaccggaaacggctgcacggtcgcgatgcacgcgccgaagatcgccacaccgagcgccgacccgctctgccgcgccgcgttcagcgcggccgccgccacgcccgcgcggcggcggtcgaccgtcccgagcgccggcgacgtcgcggcgggcgagatgaatcccgatgcaaagccgatcgcgagcatcggcgcgacggcgagccatgccggtgtcgccgcaccgatgcccgtcatgccgagcgcgccggccgcgtagagcgcgaacgcggcgcacatcgagccgcgcgcaccgaagcgtgccacgagcctgcccgagcacagtccgccgagcgcgaccatcgccgtcatcggcaggaacgcgagcccggtgtcgagcgggctcgcgccgcggatctgccgatagaacaggctgaggacgaacagcatgccgtagaacacgaatgccgatgccatcgacacgaacgtcgatccggcgaacagccggttgcggaagaacgcgagcggcagcatcggttcgcggcgccgcgcttcgatcgagatgaacgcgatccacgcgacggcgctcgtcgccgcgccgccgacgatcggcgccgagcgccagccgagcgacgggccttcgatcagcgcgccgatcagcgtggcgatcgcgacgatgaccgcggcctggccgccccagtcgaaatgtcgcgacgcgtcgccggcggcgcgcgtgaccgtgcgggcgagccagatgccggcaagcccgagcggcaggttcacgaagaagaggctgcgccaccggacaggtggatcagcaggccgccgatcagcgggcccgacgccatcgcgatgccgccgcagcccatccacaggctgattgccgatgcgcgcgcggccggctcggggaacgcgcggttgagcagcgcgagcgagcagggcaccagcatcgcgctgccgacaccttgcagcgcgcgggcgatcgcgagcgccgggaggctcggcgcgatgccgcacagcgcggatgcggcgacgaagatcgcgagccccgcgacatagacggtgtgatcgcccagccggtcgccgagcgtgccgcccgtcatcagcaggctcgcgaacgcgagcgtgtacgcattcacgatccactgcaggccggctatgcggctgccgaacgtgtgggcgatatcggtgagcgcgacgttgacgatggacgcgtcgagcagcacgagcgtgtagctcacgcaggtcgcggcgagcacgcggcgggccgcggcccggttcggtgcggcggccgtcatgcgtggtcgggtgccggcgcggcagcccgcagcgcgagaaagccgacccatccccagtacacgcgatgatgcgcgatcagcccgtcgcgcaggtccatcacttcgacgagatccacctggtcgccttccggcgtcgcgcgcggatattcccacgtgagctggcggccgttcgagaagaacagcccggtgcggtaccagcgcccgagccggttgcccggattgcgcaggccggccgcgaagaacgcgccgatcgcggccttgccgtgcagcacgcctgagccgtgatcgggcagcgtgacgacgatcagcggcgtttcgagcaccgcgtcgtcggtatccagcgccatcagcgcatcgacgtcgcgcgcgacgacggccgcgtgccagccttcgtaaatgtgccgggcatcggcatcggggtgtgtcatggcgggttccggaagtgtcgataacggaacccactgtatgagcgcgccgtcgcgggacgtttcacgtcgacccgaaacgtggatgccgccgcggcgaaggcggcgcttttcggccgtttttcggccgttatccggccagcgcgtcgagattcagcacgtacgacttcccgatccacactgcgcagtcgcgatggtcgcgcagttcgtcgcccgtattcggatgcaggaagatatccagcgcgccgtggttcagcacgagccacggcacgatttcgtcgaagcgcgcggtgtcgaacgcgatctggtacgaccacgccgggtgcgggccgacgaggcgttcgtgaaagcggccgagttcgatgaccgcgccgaaccgttcgtcgacgacctggcgaaacgcccacgcggcgtcgcggctggccgcatcgaaatagacgtgcgcatgccaactgtggatggcggtggtgtcgagggcagccatggaaggactcgataaaaatgggaatgcatgaggtgccgtgcgaaacggccgatgcgtgattatcgcgcgtccttgccgcgcacgtcgtgtcgctatccggcaatccggatgcgatgcttgtcctgaatcacgagaaccgtttgatccggcaaggccgcggttcgagatatccgcgggtatccgcacgcgcgatatcacgccggaagccttgccggaaggtgcgcccgctgcgatcgcatcggcaacacgtcatttcggaaattgaaaaagcgctgtgtgcacggcttcggatcgtctgaacaaatgcgatcagggcattgaatgaaataaagaaattccgattgagagggattcgcgcatgacgtggttcgcgcaccgaattccgaagccgaaaatatcaattgcggaatcggctattcaagcggcatgcagcgcgacatacgatgctttcaacgcatcgtcgaacacgatcgatgcggggacaaccacctggaggccactatgcgatccctcgttcccgttgccgtactttcctgcgcactcgttgcgctgcccgccgtcagctttgcgcagtcggccgtttccgatggggcatcgaatgcctcgctgtcgagctggtcggcggcgcgtgccgaaaccaacgcgcaactgatgcagatgacgcgcgcaggttatcgcgcgacgtcggccggcaaccagaactatccgctcgcgatgcagcgtgcgctcgaacgtgtccgcaatccggtgccggaccggtcgcgcgaagagcgggccgagatggaggcgcgcgccgcacgcgacgcgcagggcggccatccggtcaaggccttcttcgtgaagaccgcgtactacctgaagggcgagaacacgttctgatgcaggagacgagcatggcttgcccgatccgatttgcctgcgtcgtgcgcgcgccggcgctgcgccggctgccggccgcgcgagcgtcgcagcggcgggacgatgcgcgcggcgcgcgacgtcgtgcgaaacaccgccgccttgcgcaccgtgatgccgttgcgtgccgtaccgcatggccggccgtcgcggcgagcgatgcgcccgcgagcgggagcccgtcatgaaaggctcccggaagcaccgccgccacgtgccgctgacccgcgagtggttgctgccgctgccgccggtgcatgcacgcgacatctcgctgaaatgccacatggcgctcgtcgcgctgcgcggcgggcatggcaacgaggcgctgctgatgcggttgcgcacgagcgtctacctggtgttcctggcgctcgacgatgcggtgtgtgcggatgccgacatcgacctgtgcgtcgacgccgagcgtgcgctcgacgcgggcgtggcacgcgcggcgcaaggcggcgcatggacgctgcacgacgacgaatgcgcggtgctcgagcatgtgctcgcggcgaacgacacgtgcgtcacgacgctcacgcggcgtcggctggccgagctgtgggagcacgtctgcgcgttcgcgtcgagcggccagccggcgctcgtcgcgggcgcggcggagaagatgcgggtgcacgcggccgaatcgctggccgcgtagcgtcgcaccggttttgccgggagtctggaggagacaggaccggccgcaccggtgcggccgccgtcaatcgccgaagcagcgattgcacggctgtcgcagccagtcgtggcctgtcgtggccatacggtgacggcggaacgcgactcgacacatcggcccaaaacaaagcgccacggagcaggctccgtggcgcttctttccgccggcgcggagggcaagccccgcgtggcgaaacgcgcttaagcggcggctgccggcttcgccggcttctgcagcttgcccttgccggcgcgctggatttcctcgagcttgatctcgacgtggcgcgagaacacgtactcggccggacgctgcttgtcgatcggaatgtccggtgcgaacgggccgtcggtcttgatgcccttgcggctcacggcgaacgccttcagcggatgcgccatcgtgtccatcacggcggtcgcctcgaagccgcagtggaccatgcagtccgcgcacttctcgtagttgccgacgccgtagttgtcccagttcgtgtcttccatcagttccttgaaggtcttcacgtaaccttcgccgaccaggtagcacggcttctgccagccgaacaccgtacgcgccgggttgccccacggcgtgcacttgtacgtctggttgccggccaggaagtcgaggaacagcgacgactggctgaacgaccagcgcttgccgccttcgccgcgcttcaggatctcgcggaacaggttcttcgtcttgtcgcggttcaggaagtgctgctgatccggtgcgcgctcgtacgcgtagcccggcgacacggtgatgccgtcgacgccgatcggcttgagcgtatcgaagaacttcgcgacgcgctcggggatcgcatcgttgaacagcgtgcagttgatgttcacgcggaagccgcggcgcttcgcttccttgatcgccgcgaccgccttgtcgtacacgccttcctgcgacaccgagtggtcgtgcatctgcgcgtcgccgtcgaggtggaccgaccagacgaagtacgggctcggctggtagtcgtccatcttcttttccatcagcagcgcgttcgtgcagaggtagacgaacttcttgcgcttcatgatgccgcggacgatttccggcatttccttgtgcagcagcggctcgccgccggcgatcgacacgatgggtgcgccgcactcgtcgaccgcttccaggcattcctggacggacaggcgctggttcaggatgggatccgggtaatcgatcttgccgcagccgttgcaagcgaggttgcagcggaacagcggctcgagcatcagcgcgagcggatagcgtttgttgccggacaggtgttggcgcgtgatgtacgcgccgacgcggacttgctggagcagcggaatagacaagagatgtcctccttaaacttcgcgggcgacagcttgcgtgagcttcgccggcaacttgaattcgactttttcttcacggcccgccatcgtcgtgacgtcgacggggcccagcgcgcgcaacgcgccgattacatcttcgaccatttcctcgggcgcggacgccccggcggtcaggccgacggtcgtcgcattcgcgaaccattcggccttgacttccgaaccgtcggcgacgagatagctcggcacaccgctttcggtgccgatctcgcgcaggcggttcgagttcgagctgttcgtcgcaccgaccacgagcagtacgtcgacctgttcgctcagttcgcgcacggcagcctggcgattctgcgtggcatagcagatgtcgcgcgtgtccgggccgacgatgtcggtgaaccggcgctgcagcgcttcgatgatgccgcgcgtatcgtcgaccgacagcgtggtctgcgtgatgtacgcgaccggcgtgtcgacgggcagcgtcagcgtatcgacttccgcttcgctttgcacgaggatcacctcggccggaatctggccgatcgtaccctcgacttccgggtggcccgcatggccgatcaggatcagccggcggcccgccgcgacgtactggcggccttgcacgtgcactttcgtgacgagcgggcaggtggcgtcgagcacgtcgagcccgcgcgtttccgcatcgcgctcgaccgtctgggcgacaccgtgcgcgctgaagatcgcgacagcgccgtggggcacctcgtcgagctcctcaacgaatcgcgcccctttattacgcaggttttcgacgacatgccggttatgcacgatctcatgacgcacatagaccggcgcaccgtgctgttgcagcgcgcgatcgacgatctcgatcgcacggacaactcccgcacaaaagccgcggggctgggcaaggatgactcgcataagtgagcgaactccgacgacagacgccggggttcgaggagctggcactcgctcgctcgccccggcttgatgttatgaaggcaggaacgaaccggccggccaggccccggaaccccgaattaatcgcgcattttaactctatcgggccgtccttgctttggtgctgtgtctgccgtgttgcatttgcgggagagccgcgtcggcgctggcacgtgcggaacccagtaaactatgcggtttcgcgggcagccgctccggctgcccggcgtcgcgctcatttcaaggccattcgatgaccgtcgattcttacgcgtattacccggccgcccgtgccgtttcgggcgctttgttcctgaccccattgattttgccgaacccggcgcccggcaggaggcgcgccgatgatgctggttctcgctttcctggtgtccgggctgtcgctgatcatctggatcgtgctgctcgtcgcgcgcggcggtttctggcgcgcggtgcccgcgcggccgctgccgcccgaggcgcgcggcgccgcggccgaggccggctggccggccgtcgtcgcggtcgtgccggcgcgcaacgaggccgacgtgatcgcccgggcggcgacttcgctgctcgagcaggattatccgggcgaatttcatctgatcattgtcgacgaccacagcgacgacggtaccgccgacgcggcccgcgcggccgcgctcgcgatcaaccgcgccgaccggctgacggtgctggccgcgaagccgctgccggccggctggtcgggcaaggtgtgggcgcagtcgcaggggatcgccgcggtgcaggcgctcggcctgccggccgactacctgctgctgacggacgccgacatcggccatccgccggacgccgtcgcgcagctcgtcacgcgcgcgcaggccgagaaccgcgatctcgtgtcgctgatggtgcggctgcgctgcgattcgttctgggaaaaggcgctgatcccggcgttcgtcttcttcttcgcgaagctctacccgttctcgtggatcaacaacccgcgcaaccggacggccggtgccgcgggcggctgcatgctggtgaagcgcacggcgctcgaggaagcgggcggcatcgagtcgatccgcggcgcgctgatcgacgactgcagcctggccgcgcagatcaagcaccgcggcagcggccgccacccgatccggctcgacctggccgaccgcagcgtgtcgctgcgtccgtacgacagctggcgcgacatctggaacatgatcgcgcgcacggcgttcacgcagctgcactactcgccgctgctgctggccggcacgctgctcgggatgacgatcatctatctcgtgccgcccgccgcggcgctcgcgtacggcgcgcgcgcatggccggcgtggctcgcgtgggcgtcgatgtgcgccgcgtatgcgccgatgctgcgctactaccggcgctcgccgctgtgggcgcctgcactgccgctcgtcgcgctgttctacgtcggcgcgacgttcgcgtccgcgtggcgctactggcgcggcaagggcggccagtggaaggcgcgcgtgcaggcgccggtggagcgctgagcggatcccgggaggcgtgcctcccggcagccggaaagcaaacagcccgatcgtggaaacggtcgggctgtttcgttttcggcggggctgcctgccggtgcctagcgctgggtcagcatcatgtacatctggatcacgacgtccggcgagaacgtgaacggcacccagccgtagcccgtgtgacgggcgaccagcaggcggtcgccgttcgactgcttctgcacggccatcatcgggttcttcgtcgtcacgaagcgccagccggccgggatgccgggcggcggctccggctgcatcgacgcgcgcgcatgcgcgagttcctcgatcaactggcccagttgctccggatgcagcgtgatcgattcgccgttgatggtcagcgtgagttcgttctgcgtcggacgcgacacgtgcagcgtcgatttgtcggacggcgccggcgtggtggcggcttcggcttcggcttcggcttcaccttcaaccggcgtgtcggcttgcgccgtcgcgacgattgccgtcccggtgtcggccgttgcctccaccgcttcggccacggccggctcgggcgcgttcacggccggttccgccgccggcgtgtcggccggcgcgggttcgacgacttccgccgcaacggccgtggcggccaccgcgctcgtcgcggcttccttgacgacggcctcgaccagcgcctcggcgtcggcgatggccttcgcgtggtgctgcgcagccgcttcggcttgtgcgatcgcttcggtatggcgttgcgtgacggcctcggcctgcgcagcggcatcggcgtggcgttgcgcggccgcctcggcctgcgcgatcgcttcggtatggcgttgcgtgacggcttcggcctcggcggtggcgtcggcgtgacgctgcgcggcggcctgcgcttccgcgatcgcctgcgcgtgctgctgcgcgagcgcttcggcttcggcgatcgcggccgtgtggcgctgggcggcggcttcggcttccgcgatggcggccgcgtggcgctgcgtggccgcttcggcttcggcggtcgcgtccgcgtgacgcttcgcggcggcctcggcttcgacggtcgcggccgcatggcgttgcgcggccgcttcggcttcggtggctgcggcgtgatgacgctgcgcggcggcctcggcttcggcgatcgcggccgcgtggcgctgcgacgccgcttcggcatccgcgtgacgctgcgcgagtgcttcggtcagcgcggtggcttccgcatggcgttgcacggcggcttcggcttgcgcggtggcatcggtatgacgctgggcggcggcttcggcggcggcggtcgcgctggcgtggcgctgctgcgcggcctcggcttcggcggcggcggccgtgtggcgttgcgcggcggcctgcgcttcggtttccgcggcggcgtgacgctctgccgcggcccgggcttccgctgctgcggcgcgcgcgaaggcttccgcgctgcgggccgcctgctgcgcggcgtggtgatcgtggaggagctgatcgacgcccacggtgagcgaagcgatctgatcgttcaggttcatgcgtgtcttctctgcgtaagacccgcgattttaaccgctgcgccggtgccgggccgtgcgcgacgtgtaacaaagtgcgcaaagcggcgtgaagtacgccgctttgtgttacttcaggtagcccgcggagccgaaccagtcgagcgcatcgcgcagcccttcgcggtacgggcgcgcacggtagccgagctcgcgctcggccttcgccgacgtgaaatacatcttgttcttcgacatccgcagcccgtccacggtgacgaacggctccttcttcgtgaacttcgcgaccgcttccgcgccgactgcgagcggatagagcggccagcgcggcagcgcgatcgtcggcgccttgcggcccgtcatctgcgcgatgtcggcgagcatctgctgcagcggcaggttctcgccgccgaggatgtagcgctcgccgatccggccgcgctcgagcgcgaggaagtggccgtgcgcgacgtcgtcgacgtgcacgaggttcagccccgtgtcgacgaacgccggaatcttgccgagcgcggcctcgacgatgatgcggccggtcggcgtcggcttcacgtcgcgcgggccgatcggcgtcgacggattgacgatcacggccggcagcccttcgtcggcgatcatccgttcgaccgcgcgttccgcgagcaccttgctgcgcttgtagacgccgatcgcctgttccgccgtgagcggccggttttcgtcggacggatcgccggcactcgtcaccttcagcgtcgcgacgctgctcgtgtagacgatccgctcgacgccttccgcgcgtgccgcgcgcatcgtcgcgaccgcccctcgaggttcgcgcgctcgatttcgtcgggatcgggcgcccacagccggtagtcggccgcgacatgcagcaggtagcgcacgccgcgcagcgcggcgcgcatcgacgcctcgtcgcgcatgtcgccggtgacgatctcggcgtcgagatccgccacgttcgtgcgcgggctggtcgggcgcacgagcacgcgcaccgcatagcctttctgctgcgcgatgcgcgcgacggccgagccgacgaaaccggacgcgccggtgacgagaacgagatcgcgggaggtatcagtcatgcgtttccttcagggccgcgcgcgggcggcgcggcggttgagcgtcggcgagattgtacgtggtcggcgcgcgcggcgacgcaaggccgcgacgggtgcgggcatgtacgaagcggccgacgcgactacaatgccgggcttgaacgcaacgggaggacgacgcgatgagccgcaatgaactggacgaacggatcgagacctactacgtacgggtgcgcggcgtcgtgcagggcgtcggcttccggcatgcgacggtgcgcgaggcgcatgcgctgaagctgcgcggctgggtcgcgaatctcgaggacggcaccgtcgaagcgatgatccagggccccggcgcgcagatcgaccggatgctcgcgtggctgcgtcacgggccgccggccgcgcgcgtgaccgaggtgacgttcgaggaacgccggaccgagaagcgcttcgagcgcttccagcagcagtaagcggcacggaacgatcatgacggggtatccggaggccgggcgcggcctcatgctgtcggtgacggcatcgacgctgttcgcgctgatgtccgcctacgcgaaactgctcgcgccgctcacggggctcgacatcttcgcgtggcgcgtgttgtggaccgcaccgggcgcgctcgcgctgatcgcgctgcgcggccgctggccggcgctcgtcgacctccttcggcgcagcgtgcgcgactggcgcctgctgatcgcggtgcccgtgagcgccgcgctgctcggattgcagttgtggctgttcctgtgggcgccgctgcacgggcgcatgctcgaagtgtcgctcggctatttcctgttgccgctgacgatggtgctcgtcggccgcttctactatcacgaacggctcgatccgctgcaatggacggcggtcgcgtgcgccgcgctcggcgtcgcgcacgaagtgtgggcgacgcgcgcgttcgcgtggccgacgctcgtcgtcgcgctcggttatccgccgtatttcgtgctgcgccggcggatcaacgccgattcgctcgccgcgttcgcggtcgagatcgcgctgctgtgcccggtcgcgttcgcgatggtcgcgacgagcgcgacgcgcgtggccggccatcccgtgctgtgggccgcgctgctgccggggctcggcgtgctgagcacgctcgcgctcgcgagctacctgaaggccagccggatgctgccgatggccctgttcgggattctcggctacgtcgagcccgtgctgctcgtcgcggtgtcgctgttgctgctcggcgaaacgctgagcgtcgcgaagctcgcgacgtacgggccgatctgggtcgccgttgcgctgaccgcgtggcacagcgccatgctgatgcggcgcctgcccgcgcgcggataggcacgcggataggcgtcgatcgcgatgcggcggcggcgcggaacgtggcgtagatcgcatcggtatcggcatcacccggcggtcgaacccgtcgatgctgaccgcaaactggcgtcgcgctggcgcgaatctggcgacgctgcctgcttcgcgtcacaaggctcgcgcgtgtaatcgaacagaagattcggttgcactttgttacttagggtctctcctgatcggctactagactggcctcaccgacttcccttcgtatgcagccttttaatgaacggtcctctccgtgcctggccggccgggttggcgcgatgcgggcatacgcgtatcgcggctgatcccgcgcgccttcttcttcccgatccattcccggtgcgtgccgcaccgccgtcgtgcgggtgcgctcatgtcgttgagcgtgccgcccgccacggctcggccgccgcggccgcctgatcgaagtcgatttcttccgcggcatcgtgctgttgatgatcgtcgtcgatcacatcggcgcgagcgtgctgtcgcgcgtcacgctgcacgcgttcgcgctgtgcgacgcggccgaggtcttcgtctttctcggcggtttcgcgaccgcgagcgcctatggcgcgatcgccgaacggcacggcgcgcgcgccgcgcaacggcggttcgtgcgccgcgcgatgcagatctaccgcgcgtttctcgcaacctcgacgctgatgctcgtcgtgtcggccgtgctcgaccattacgggatcgatgcgccgaacctcgcgctcgacgacgtcagcgtgatgctcgcctcgccgctcacgggcctggccgaactgctgacgttccagcgccagccttatctcgcgtcggtgctgccgatgtacgtgctgttcgcgctcgcgtcgccggtgctcgtgccgttcgcgcgccggcatccatggctgctcgtcgcgctcggcattgcgtcgtggatcgcggcgggctggctcggccccgagctgctggacaccgacggattccgctggagtttcaatccgttcgcgtggcaactgatgttcgtcgccggcgtgctcgcgcgctgccagccgttctaccggtgcatcgcgctcggccgctgggggccgcggcgaccgggctggcctgcgcggtcgtgctcggctgcgcgagctacaagctgttctcggggctgccgctgccggaaggcgtgttcaagcgcgatctcgcgctgccgcgcgtcgtgagctttgcggccatcgcgtggctgatggccgattgcgtgcgcttcggctggatcgcgcggatcgcgcagggcgtgcggccggtcgtggccgtgggccagcgcgggttgatctgcttcgtcgcgggcgcggcgatctcgctcgtcatcgattcgctcctgcatccggtcgtgggcagtgccgacctgcggcacgtcggcgtgggtctcgtggccgacgcgtgcgcgctcgggctgatgatggccgtggccggttcgggaacgtggatcgcgcggtggcgcggtgcggccgcgtgagcggcgcgggcggcacggaacgtgcggcgcggcgtcagtgaggtgagccgatacgggagcggggaacagcggtggggtcgtcggattcggcgtcgtcgcgctcgtcgggcgccggatcgtcgcgttctgcgagtaccgcgtcggcttcggctgctgcccgggcggcgcgcagcgcagtgcatcgctgcgcgtaccggatgtccgagaggatccggaggagcctcgtggtcttgctttcatggtcttctcccgccagcgcgcatcgcggcggatgcactgctttgcaaccagtgtaggacgcaatcgcgcaaccggcgggagaatgtggcgtgcaggccgcacgccgagggatagtccttactgggccgtggcggcaccctgcgcctgcagcgattcctcgcggcgctcttccgcacaacgttggtgctggcgcgacaggcggttcatcagcggcagcagcagcagcgcgagcagcatgccgatcgcggcgagccagccgagcttctcgaacagcgacaggtagagcggcagcgattcggtggccggcagttcgtgcgacggcatctgcgcgaagttcgcgacgacgctgcccagatactgcgacacgcccgtcgcgacgaagtaggcacccatcatgaagccgctcatgcgcgccggcacgtagcgggcgatcatcgcgaggccgaggccgctcaccagcagttcgccgagcgagtagaggccgtagccccacaccatgaaccacgacgacacgcggccgtccacggcaaagcggccgctgatcgtgaacaccaggtagcccgcggccactgcgccgaagccgagcgcgtacttcgcggcgaccggcaggtcacggccgcccttcgcgacggcgttgtagacccacacgagcaccgggctgagcagcatgatccagatcgggttcagcgcctggaactgcgcggcgctccacgtgaacagcgtcgtgccgaacagcatgaagcgcggatcgacgttgcgcagcgcgaacagcgtcagcgacgtcgacatctgcacgtagaagatgaagaacaggatcacctggccgatcagcacgagcgccgcgatcaggccggcgcgctccgagcgctccgatttcgcgatcatgtacgcgaagatcgcgaggatcgcgaacgctgccgtccacacgctggcgacggcgagctgcttgtgctgcagcgtacagcgtgaccagcgcgagcccgacaccgcccagggcgaccgcgccgaggcgcttccagcggatcggctggtcgtcgggcagcgagccgacgtgtgcgagcgtgcgatgcatcagcatgaagttgaggatcgcgagcagcatgccgccgcagcagaccgcgaacgcggtgtgccagccccagtgatccttgatccacggcgtcgcgagcatcgacaccgtcgagccgatgttgaccgccatgtagtagatcgtgaacgcgctgtcgatgcgcgcgtcgtcgccttcatagatgcggcgcacgaggttcgccgcgttggccttgaacaggccgttgccgacgacgatcacgccgagcgacgcgtacatgtacgtcagctggtcgttcggtaccgacagcatcaggtagccggcgcagagcacggacgcgccgatgatcatcgtgcggcgggcgccgagcaccttgtcgccgatccagccgccgatcgacggcgcggcatagacgagtgcggtaaacgcaccccaggtcaggttcgcatggctgtcggtgaaaccgagccggtcgaccatgaagaggaccaggagcgcggccatgccgtagtagccgaaacgctcccacatttcgatgaggaagaccgtcgtgaacgatcgggtttgtgaaacaggtggttgcatcatcaatctcgtttgaaacggacggcacggatcgcgcgtcgtcttggggtcgaactggcgccgatgcacaatgggccgggtaagctttgcgctggcgatggaacagtcgggcggttagcccgggccggggcctgactccgcctggtgtggcggggaagggccccgaccggcgcgcgcatggtaacggctgccggtccggtgcgtctggtatccgccacttaggaaactcctaatgtggcagtagctttcaggaacattcgtctcatcatttacttgtaagctttcatgccggctctccgaatattcccggagagccgcttgcagcttgcctgtgaagccggcgagtctggcaagatagcgcgtcgtttcgctcgcttcgtgtcccgtttagtgcaccgggctcaacaccgaagacgggtgcgaacccgaagactaagctatatcgttctaacttagttattttccatcaaacatttttgacgatcacttttcggcctgctatggttcccccactgaaaactcgcggtccgcagatgctgccgccgctctgggcagcaagattcgcgcgttgcgccaacgactcaagcgcacgctcgacgacaccgctaccgccgcggggatttcgaagccgtttctgtctcaagtcgaacgcgggctcgcgtcgccgtcgctgacatcgttggccggtatcgcgcacgcgctcggtgtgacggtgcagtacttcgtggatacgccgagcgaggaacgctcggtctgccgaggcgagcagctgcgcttcttcgggtttgccgattcggcgaacctgttcgcgaggctgacgaacgtgtccgaagggcgccagctggaggcgatcctcgtgaggatgccgccggggcagaagcggtctgaggtgacgacacatgcaggagaggagttcctgtatgtgattgaaggggaagtgtcgctgacgctggaaggcaagacgttcgtcctgcaggccggtgacagttcgcactatcagtcgacggtcccgcacagctgggtcaacaccgcgaagatcgagtcggtggtggtctgggtcggtacgccgaggctgttctaacgcacaggtattccttcgtttcgaagacggaatacctgtcgaaagaaacgtaaggaatactaaaatgcaatacgagaatcacgggcctcctcaatcgctgcgcccgtcagcgtctcacgcgtaagccgcggcatccgccgcgcgacgctcaccgaacaacccttctcaagactgccacgatgaaatccttgcatgccatgtcggccgtgctggccgcgctcgccctgacgcctgtcgcccacgccgtttccgttccgtcgaacgtcgcgctcgctcctcaacaggacctgacgcgccaggtgcctgccgaagtcgagtcgctcgacccggcgcacatcgaatcgtggaccggcaacacgatcggcctcgacctgttcgaagggctggcgcgcatcgacgcagccggccaggtcgtgccgggtgtcgcgctgtcgtgggaacgcaagacgccgacgacgtggatcttcaagcttcgccgcgacgcgaagtggagcaacggccagccggtgacggccgccgatttcgtctatgcatggcagcgcctcgtcgatccgaagacgggctcgaagtacacgatcctcgtcgagttcgtgaagaactcgaaggacatcatcgcgggcaaggccgcgccgtcgacgctcggcgtgcgcgccgtcgacccgtacacgctggaagtagcgaccgacgtgccggtcgcgttcttcccgagctcaccgcgatggtgccgctcgcaccggtgaacaaggacacggtgacgaagctcggcgacgcgtggacgcgcccgggcaacatcgtcagcaacggcgcctaccagctcgtcgactggcagccgaacaaccgcatcgtgatctcgaaggatgcgaaatactggaatgcgccgaaggtcgtgatcaacaaggtcacgtacctgccgatcgagagcgacgagacggcgatgcgcatgtaccaggccggccagatcgactacagctactcgatcccgtcggggatcttccagcaggtcagcaagcagttcggcggcgaactgcgccagggcctgcagctcgcgacctactactactacctgaacaacagcgatccggcactgaaggacaagcgcgtgcgccaggcgctgtcgatggtgctcgatcgcgacgtgctgacccagaagctcacgcaggccggcgagaagccgatgtacggcctgatgccgaacggcacgaagggcgtgcagccgttcacgccggactgggcgtcgtggccgatggccaagcgtgtctcgaccgcgaaggacctgctgaagcaggccggctattcggacgcgaagccgctgtcgttcacgctgacctacaacaccaacgacctgcacaagaaggtcgcgctgttcgcggcgtccgaatggcgtaccaagctcggcatcaacacgaagctcgagaacgtcgagttcaaggtgctgatgaagcagcgccatgacggcaaggtgcagatcgcgcgcgacggctggttcgccgactacaacgatgcgatgacgttcttcgacctgctgcgttgcggcagcgcgcagaacaccgtcggctactgcaacaagcaggtagatgcactcgtcgacgaaggcaaccagaagctcgacgacaaggcgcgtgccacgctgctcacgcaggcacacgatctcgcactgaacgacacgccgatggtgccgctgttccagtactcggccgaccgtctcgtgaagccgtacgtcggtggctactcgctgaagaacgtgatcgacatgcgtgcgtcgcaggacatgtacgtgatcaagcactgagcggagcgatcatgctggcctacgcattgaggcgtacgttgtgggcggtgccgacgatcctcgcggtcgtcaccgtctgctacctgctgctgcacctgacgcccggtggcccgttcgatacggaaaagcagctgtccgcggcgacgctcgcgaacctgaacgcgaagtatcacctcgaccagccgctgtggaagcagtacctgatgtacctgaacgcgctgctgcacggcgatctcggtccgtcgttccgttacgtcgactggtccgtgaacgacctggtgcgcaaggcgctgccggtgagcctcggcgtgggcggcctgtcgatcccgatctcgatcgggctcggcgtgctgctcggcaccgtcgcggccgtgcgccgcgacagcttcatcgaccgcatcgtgatgctgatcggcaacgtcggcaacgtcgtgccgccgttcgtgctcggccccgtgctcgtgtggatcttcgcgatcctgctgaagacgtcggccggtaacggctggctgccggcgggcgggtggggcgacggcggctggcagtaccggctgctgccgatcgtgctgctgaccttcatcaacatgtcgctgctcgcgcgcgtgatgcgcggctcgatgatcgagacgctgtcgagcaactacatccgcaccgcgcgcgcgaagggcctgccgggctcgacgatcgtgctgcgccatgcgctgaagcccgcgctgatgccggtcgtgtcgctggtcggcacggtctgcatctcgtcgatcaccgcggccgtcgtcaccgaatcggtgttcgcgctgccgggcctcggccagctcgtcgtgaacggtgcgatcaaccgcgactacacgctcgtgctcggcctcgtcgtgctgaccaccgtctgcgccgtgctgttcaacctgctggtcgacctcgcgtacgcgtggctcgatccgcgcatccgttattgagcgaggcaccgcgatgactccgactactcccgtcgtcggcctgcccgtgcagaccgacacgccgccgcgttcgcgctcgccgctcgcgcttgccatggcgcgcttccttcacaaccgtgcggccgtgttcagcctcgtgctgctcgcgctgatcacgatcgcgtgtttcgtcggcccgtggctgctgaccgccgacccggccgcgagcgactggggcgcgatcagcctgccgccgacctgggccaaccagcactggttcggtaccgacgagctcggccgcgacctgctcgtgcgcacgctgatcggcggacgcgtgtcgatcgaggtcggcttgctcggcacgctcgtgtcgggcctgttcggcgtcgcgtggggcgcgaccgcgggcttcgcgggcggccgcaccgatgccgtgatgatgcgcgtcgtcgacatgatgtacgcgatcccgtacctgctgatcgcgatcctgatgatgaccctgttcggccgctcgttcatgctggtcgtgctgaccatcagcgcgttctcgtggatcgacatggcgcgtgtcgtgcgcggccagacgctgtcgctgcgcagccgcgagttcgtcgatgcggcgcgcgcgatcggcgtgacgccggccacgatcgtgcggcgccacgtcgtgccgaacctgctcggcgtggtcgtcgtgtacgcgacggtctcggtgccgggcatcgtgctgaccgaatcggtgctgtcgttcctcggcctcggcgtgcaggaaccgatgacgagctggggcgtgctgatccaggacggcgcgcagaaactggaatcgatgccgtggctgctgctggccccggccgtcatgctgtgcgtgacgctctactgcgtgaacttcgtcggcgatggcctgcgtgacgcgctcgacccgaaggatcgctgaaatgggtgcactgctggaagtagacaacctcggcgtgcgcttcacgcgcaaggacgcgccgccggtcgacgccgtgagcggcgtgtcgttctcgctcgaagccggcaagacgctcggcatcgtcggcgaatcgggctcgggcaagagccagaccgtgatggcgctgctcggcctgctggcgggcaacggcacgacgacgggcgccgcgcgctatcgcggcgacaacctgctcgagatggatgcgcgcgcgctgaacaaggtgcgcggcgaccggatcgcgatgattttccaggacccgatgacgtcgctcaatccgttcctgacgatcgagcggcagatgaccgagacgctgcagctgcatcgcaagctgtcgcgcagggaagccacgaagcgcgcgatcgaggcgctcgaatcggtgcgtatcccggacgcggcgcgccgcatccgcatgtatccgcacgagttctcgggcgggatgcgccagcgcgtgatgatcgcgatggcgctgctgtccgagccggagatcctgatcgccgacgagccgaccaccgcgctcgacgtgaccgtgcaggcgcagatcatcgacctgctgcgcgagctgaaccgcgagcgcggcacggcgatcgtgctgatcacgcacgacatgggcgtggtcgcgggcctcgcggacgacgtgatggtcatgtatgcgggccgcaccgtcgaatacgcgccggccgaatcgattttcgcggcgccgtcgcatccgtacacgatcggcctgctcaacgcgctgccgcgcctgaccgacgcggacgatgcgccgctcgtcgcgattcccggcaatccgccgatgcccggcaccgcgccggccggctgcgcgttcgcgaagcgctgcacgtacgcggaagaacgctgcggcgcggcgcgccccgcgctcgaaacctatggcgccgtgggcgcggtgcgcgcatgccaccgccccgtggccgatatgacgggaggtctgcgatgagcgtcgatgaacgccgcaataccggcgcgacggacgacacgctgctgtccgtcgatgggctgaaagtgcatttccgcgtgccgctcggcggctatccgtggtcgccgaagggcacgctgcgcgccgtcgacggcgtgtcgttcgacgtgaagcgcggcgagaccgtcgggctcgtcggcgaatcgggctgcgggaagtcgacgctcgcgcgtgcgctgatcgggctcgtgccgatgacggccggcgccgtgaaatggcgcggcgaagccgtggcgcccgatcacctgcgcggcaccgcgatgcggcgcgaagtgcagatgatcttccaggatccgctcgcgtcgctcgatccgcgcatgacgatcgaacaggtcgtcgcggagccgctcgtcacgcaccaggccggcctcggccgcaccgaggtgcgccgccgcgtgatcacgatgctcgaacgcgtcggcctgaacgcgcatcacctgctgcgctatccgcatgaattttccggcgggcagtgccagcgcgtcggcatcgcgcgcgcgctgatcagcgagccgaagctcgtgatctgcgacgaacccgtatcggcgctcgacgtgtcgatccaggcgcagatcgtgaacctgctgcgcgatcttcaacgcgaactgtcgttgtcctatctgttcgttgcacacgatctcgccgtggtgaaggcgatcagccagcgtgtgctcgtgatgtatctcggccgcgtgatggagttcggcacgcggcatgacgtgtacggcgtccctcaacacccgtacacgaaggcgctgctcgatgcggcgccgacgccggagccggcgcgcgagcgtgctcgccgcccgatgctgctggcgggcgagatgccctcgccgctcaacccgccgtccggctgtgcgttccgcacgcgctgcccggtcgcgatcgatgcgtgcgcgcaggacgtgccgctgccggaagttcggcaggggtcggcagcgcgtgtcgcgtgcatccgcgcgggtgtggcgtgagctgaagtgacgcagcaaacataaccaaggcaggtcaacaggggtaggtgcggcgcgaacgatcttcgcgccgcgggtacaggcgcgtccttaaccgggcgcgccgggggccgggagcggatcgcagccggcgtggacgatatcaacacaagacgagaattacgatgaagaaacagaagacgatcgggacggcatcgaaaatgctgctcgcatggggctgccggcactcgccggtgtctcgctgacgggcgtcgcgcacgccgacgacgcggcccccgcaccgctgacggtcgcccaggccgcaccgggcacgaccgttgcgcaggcaacgaccccgaacgccattgtcaacgccgaagcgacccaggccgtcacgccgcccgacgagccgtcggcccagtcgcagtcgaagggtttcattgccgacagccacctcaacttcctgttccgcaactatgcggacgtgctcgacgccaagggcgggccgcatcgccacgcgtgggtccagggcgcgatggcgaacttcgagtcgggctatacgacgggcctgatcggtatcggcttcgatgcgtcgctgtatgcggcgctgaagctcgacggcggccagggcgccggcagcatggtgcacatcgcgaagggcggcggtggtggcaaccagctcgcatgggcttatcccggcatctacgacgtgaaggcgcgcatctcgaacacggtggtcaagtacggtctgcaggccgtcgacaacccgttcatggagcagcacgacaaccgtgcgctgccgccgacgttcctcggcgcgacactcgtcagcaatgaattcaagaacgtgatgctcgaggccggcagcttcacgaagaccgacgcgcgcggtcacacgacgctcaccaacctgacgacgcaatacggcggcacgcgcatcaatcgcctgtcgtacgtcggcggcacgtgggattactcgccgaacggcgaaatcgcgctgtacgcgaaccaggccgacgacgtgtggcaccagtactacgcgtcggtgaagcacagcatcggcagcccgcagacgatcaagtggacgggcttcggcaacgtctactcgacgcacgacacgggcgatgcgctgcaaggcaagatcaacaacaacgcgtacagcctgtcgctggccgcgcagcacggcccgcacgagctgctgctcggcttccagcaggtgctcggcgaccagttcttcgactacctgaacgaaacgaacggcatcttcctgaccaactcgatggacgtcgactacaacgcgccgcacgaaaagtcgctgcagctgcgttacacgttctacggcaaggaagcgggcctgccgggcttcaaggcgatggtctggggcgtgacgggctggggtgcggacggcagcgcgagcgcggcgctcgacccgagcaagtcgagcatctactggagcaacggcgcgccggtgcagggccgtcaccacgagttcggcttcatcccgtcgtacacgttccagagcggcaagctgaaggacacgaaggtcacgttcatcgcgatgtggcacgccggttcggcgcactactcggacgcgacgaacaccgagtaccgcctggtcgtgaacctgccgctgcacgcgttctgatcgaaggggcatgcgcccccgcttcgcacggccggctttcgatcgaaacgatcaggccggcttgtgcagccccgcgaccggatcgttcgcggccggcatgtcttccacgagcgacgtgagctggcggcccgtatcgcgccaggcgtcgaggccgccgcgcagcgcgagcgcatcggtgaagcctgcgtcgagcaggcgcttcgccatcagggccgccgtcacttcgttcgggcacgagcagtacacgacgaacttctgcgagagcggatagcgcgcgacgatgtcgccgatctggcgatcgtcggcgaattgcgcgccgggaatcgtgaacgggtcgagcttgcggtgctcgggcgagcgcacgtcgagcacgacgggcgcggtggtgtcgcgcagcagctggtcgagttcgtcgacgctgatccgcgcattggccagctggcggatcagcgcgcggcggcgcatccagcggatggccgcatacacggcgagcagcgcgacgataaccagcagcaccgcgcggccgaggcggctcgcgccggcgaacagccagtcgatctgccggtagaacaccagcccggccaccaggccgacgatcgtccacagtgcggcgccgagggcatcgtagccggcgaacgtgcggtagcgcgtgccgagcgcaccggccatcggcaccgataccagcgacaacccgggaatgaagcgcgcgaccgcgagcacgcgcacgccgtagcggccgaagaagcgttcggtctttctcacgcaggtatcgcgcgacagcgacagccggcagatcgtcttcagcgtcgtgccgccgtaacggcgcccggcgacgtaccacacggtgtcgccgatcaatgcgccgagcaccgacagcgccaccactgtcaccagttgcgagccgatcatctcgggatgcatcgcggacatcgcgccgaacagcacgagcgtcggcatcgcgggcaccggcaggccgatggccgccgcgagcacgttggcgaagacgagaagcggcccgtattgggcgacgaggtcacggagcatgacggctggccgaaaaggacatgcgtgggcaggaaacgcagatgggccgattatcggcctttttcaagacaacggcgggaatgacggaaagcgcctgacggcggcaggggcgcggtgagccggcgcgctgcgagcggctcaccgttcgaaatcaggaggaggtgcgggcgagcgacgcggcgccatggttttcgccgggcagctcggcgccgtgcgagcggatcgccgcgatcagttcggccggcgtgatctcgtagcggacttcgcgatggatgccgggcttgcgttcgtcgatctcgatcagcagcacgcttttgccgtcgccggttgcctcgagccggagcgagcgcagttcgcggccgtcggccgggtcgtgttcggtgagcagggtcattgccccggatgagccggtagtgcgcatcgaacctatcctcgtatcgtggatgccgtagtggcgaagatgtctttgttgaatacagctcgacgcagtttaacgcgaacgggccgcaagtcggagcattttcgcaagctgaaatgagggctgaaccatcgatccttctgatgtttgagccgcgcggggcgggcgtttgcgccggatcggggccggccgcggccggcgcccgggcgtcgttcccggccgggccggcgcgggcggcgacacgcgtacaacgtggcgcaacgcgtgtcgccgcggcggcatcagaagcggtcggcgagccccatcgccgggtcgctgaccgagtggcggccggtttccacgcggccggcgacccggcgcgagaaacccgggtcgctgtccgcggtgacgatgaagtcgtaccagtggccggtcgagtcgagcttccagtccagttcggcctggtcgccggcgcgcaccgtgaccgtccacgtggtaccggtaccgcgaccctggccgttaccgtcctcgatgccatggtcatggccgagaccgcgaccgtcgtgtgcgccgcggcccgggagcggcccgtagacctggttcgacttcacggtgaagcgcaccgtgccgccgccgtggttgcgcagccgcaggtggaggctgccgctcgcgcccgcatagccgacgcgaacttccggatgaggcgcgcgcgcaccggccaggcggctcaggtcgccggtgaagcggcggtgatagccgttcgggcccagcacccacaggtcgtatttgccgccgtcgtcggcgcgcgccgcccagtcgccgtgcagcgtcttgcccggttcgacgacgtagcgccgcggcaggcggtcgaggtgcagcttgtcatagacgtggaacacggcggcggcgcggcccgtattcgcgaacttcagcgtgagcgtgccgttgccggcatcggcacgcgcgctcgcatgcagctcgtaaggcagcgcgcgcgacgggcgcacgccggtggcctgcgccggcagcgacggcgcggccggcggcacgatcttcggcgcggcctgctgcgcggcgctcagcgcgtcgacctggcttttcgtcgtacggcccgcgagcgtcggcagcggttcgttgttcggcgagcggaagttgaacgcgctcgtcaggtcgccgcacaccgcgcggcggtacgcgctgatctgcggctcggcgacgccgaagcgcttttcgaggaagagcaacgtcgatgtatggtcgaacacctgcgagttgacccagccgccgcggctccacggcgacacgacccacatcggcacgcgcgggcccgggccgtacgggcggccgtcgatcgccggctggctcgacgtggccggcgtgaagtcgtggtactcgacggccacgtcggcgtcccgcagcgtatggccgcccgcgagcgtgccgtcggcgttgcgcgacggcacggccggcgacggcatgtggtcgaagaagccgtcgttctcgtcgtagttgaccagcagtaccgtcttgctccacacctccgggttcgccgtcagcgcatcgagcaccgcctgtacgtaccagccgccctgcgcgggctcgacggccccgggtgttcgctgtacacggacggcgggatgatccacgacacctcgggcagcttgccgttgcggatgtcgtcgcggaacgattcgaggaagccgtacggcatcgtgttgccgaaccccttcgcgagcgggctcagcggatcgtcgatcgccggatcgtagaacgcgccggccgccgtcacgggctgcgtgatgtccgtcgacgcgacgtaggcgggccggcgcgcgggcggcatctgctcgatcgccgcgcgccagtggcggaagctcatcatctcgttgcagccgaagttgtcgatcaggctctggtagaccttccagttcacgccggcctgctgcagccggtcggcgtaggtggtccaggtccagccctggctcgacgggccgatgtcgttgccgccgttgaactggttgttcagcgcggcgatcttcacgcggctgccgtcggccgggctgatgccgttcgggccgttggtgccgctccagtagaacaggcggttcgcgatcgtgcccgtgtgcatcccgcagtgatagtggtcgcacagcgtgaacgcatcggcgagcgcgcgctggaacgggacttccgccgcgtcgtagtagcccatcgacagcggcgtcttcgcgtcgggccagcggttcatccggccatggtcccaggcggcctgcgcatcggcccacgtgtgcggcgtgccgcccgcgcgctgtgcgttgccctggctcgcgtcgaggtgatacggcgtgacggtggcggcgggcgtcggcttcgtgtacgtctggtagaacacgttgcggccgttcggcgacggcaccgcaaagcggtcgccgtagccgcgcacgcccttgaacgtgccgaagtagctgtcgaatgcgcggttctccatcatcagcagcacgacgtgcttgacgtcctggatggtccccgtttcgtgaaacgcgggaatcgcgagcgcgcggcggatgctcggcggaaacgcggcgagtgcggcggcggcgaggccggaagtggcggtctgctggaggaatctgcggcgtgacgtcatggcgttcgggtcctgtgatgatgggagcgttcgtgacttcgtccggcggtgcccgtgcgtcgcccgccggggcgatgcgcgcggcatgggcggtcgagtgcggcggccgcgcgtggcggaagtgcgcgcgtcgcgcgcgatccgtggtgccgcgcggatgcctgggccgttgccgcgatcctgcgcgacgcgcgctcgtgatgcgcgggccaggacgtcggcacacaccggccgggtacgtgccggattgggcggcgcccagtctagggagtcgacgtgacgccgacgtgatgaaggcatgacatcgcatgtcgcgcgcgtgacgttgcgtgcgcaacgatcgatcgggaagcatcgggaagcgatgcgtgacggaagcgggtaaggaattaccggtttccggccgccgggccggtcagattttccctgctcgtggaggcgtggcttgagcgctggtcgttgcgggggcaacggcatcgcatgacgccgatgtttcaaatgcgtgaaatcggataagctcgatccgttgctgcgcatgtgcgcagcccgcgccgcgggcgcgacttttcggaaccggcccacccatgaccgacatcaagatccggcacagcgagacgcacgacgtcgacgcgatccggcagatcgccgcgcaccccgcggtgtacatgaatacgctgcagtatccgttcccatcgttcgaaaaatggcagaaacggctcgccaacgcgcacgagcgcggcgcgagcctcgtcgccgaaatcgacggcgaggtggtcggccatctcggcctcgagttcgaaccgaatccgcgtcggcgccatgcggcagggctcggcatgatggtcgacgcgacccggcacgggcgcggcatcggcggccggttgctcgcggccgcgatcgatctcgcggaaaactggctgaacctcacgcgcctcgagctgaccgtgttcaccgacaaccgcgcggcgatcgcgctctacgagaagcacggcttccggatcgagggcgaatcgccgggttatgcattgcgcgacggcgtgcacatgtccgtgtatcacatggcgcggatcaagggccgagagtgaacgtgcggcgacgatgccgcgcgtcatattcattcaagaattcgttcgtttcccgccggctgcgcggatcgtatcgttgaaggatttgcgccggccgcttcgggcggcgttgacggttgccgcatcgatgcgtgcggcgtgcatcgacgcacgccggcttacgccacgccgcacgccggtgcgcttcatcgcttcatgaatctcgctgcatgggcgtcgcttcaggtcgtcgcttcccgtcgtcgcctggcgcgccacgccttcccgcaaccttttctttcaacggacccgcttcgatgaaaaccgctctccggaatctgactgccgcctgcctgctcgctgccgccgcgggtgcggcgtttgccgccgccgcgcccacgggcaccccggtcgcgagcgcatcgcccgacggcgcgcacctgccgcccggcatcgcgtggcagcacggcgacgtcgacgccgctttcgcgttggcgaagcgcaccggcaagccgctgctgctctactggggcgcggtgtggtgcccgtcgtgcaaccaggtgaaatcgacgatcttcagccagcaggcattcaagacccgctcgtcgttcttcgtgcccgtgtatctcgacggcgataccgaaagcgcgcagaagctcggcgagcgcttcaaggtgcacggctacccgacgatgatcctgttccgtcccgacggcaccgaagtgacgcggctgccgggcgaagccgatctcgaccgctacatgcaggcgctgtcgctcgggatgacggccgcgcatccggtgcggcagacgctcgcgaccgcgctgaagaacggtgcgtcgctgacgccggacgaatggcgcctgctggccgactattcgtgggataccgacggcgcgctgccggtgccggccgatcgcgtggccgagacgctgcagtcgctcgcgcaacgcgcgcgggcggccggcgcgaaggccgaatcggcgcgcttcgcgctgaagtcggccgtggtcgccgcgtccgacgatccggcgcaggccggcgcgctggacaagacggcgctggccgattcgctgcgcacggtgctgcaggatcccgccttgtcgcgggccgattcggacgtgctggtcgccgcgcccgcgcgtgtggtcgcgtatctcggtggcggcgacgcgcagcgcgcgaaattgcgcggcgcatacgacacggcgcttgcgcgcctgtcgaccgacaccacgctgtcgtcgatcgaccggctgatggcgctgcacggccgcgtgctgctcgcgcgcggcgatgcacgcaagggcgcaccgctcgccgtgccggcgctggccgatacggcgcgcaaacagatcctggcgtcggtgcagggcgccgcgaacgcatacgagcggcaggcactcgtcagcgaaggcgcggacacgctgaccgacgcggggctgtacgacgagtcggatgcgttgctgaaggccgagttgccgcgctcgtccacgccgtactacttcatgtccgggctggccgcgaatgcgaaggcgcgcggcgacaaggccgcggcgctcgactggtaccgcaaggcatacgatgcggcgagcgggccggcgacgaagctgcgctggggcgcgacctatttcgcgaatgcggtcgaactggcgccggacgattcggcgcgcatcgaagggatcgccgcgagcgtgctcgcgcaggccgacaagacgcgggacgcgttctacggcgcgaacctgcgcgcgttgaccaaggtcgtcacgcagttgaaccgctggcgcggcagcggcgcgcacgacgcatcggtcaggtcgatcgcgaagcagttcgacggcatctgtggaaactgcccgccggcgatccgcaggcaagcgcctgcgagcgcctgatccagccggtcaaggcatagatccggtggcactgcgtgggctttcgggatgccggccggcgtgtttcccgataccgacgaggccacccaccccatgccccacctgacgctcgaatattccgcgaacctcgacgggttcgacgccggcgcgacactgcgcgcgctcaatgccgcgcttgccgcgtccggccatttcgacgagcgcgatatcaagagccgcgcgctgcggctcgatacatttgcagtcggcacgtcgccggcgccgcgcgcgttcgtccacgcgaagctcgcggtgctgagcggccggccgactgacgtcaagcgggaattctcggagcgggtgctggcggaactgaagcggcacgtcgtcgcgccgcccggcatgcacctgcaactgtccgcggaaatactggaactggagcgcgagtcctacgcgaaagcggtcatcgagccgcgctgaccgtgcagcgcggtgagcgctgcgcgcgccgggaacgtggcgctgacgcgagcgcagcccgctgggttgaaaccggactattggcccgtggcggacacgccgcgattgccgtagccggcgcccgcggcccgcgacgcaccttgctgccgggcgatcttagcttcggcggcctggatgctggcagggtagaaccagtcgctcggctggaagccggcttttctcagtgcaaccacctcggaatgaacttcggcgcgcgtgagcggcgaggtggcttgcgcctgcgcggcgacgggagcggcgaatgcggccgcgagggcgagtgtacggagcagcgggttcatgagcggatacctccaggttttcgacggcgccgatcacgtacggtgaccgtcgaaagcagtgtaggcctcgcctgacgcgcgaaaaatgccgctgcgcccaacgtagtgttctccggaagacaacaatgaacggccggcgcgcgcacctggacggtgcccggcaaaaggggaggagcggggagaagccggccgcagcgaagtggccggcggccggcgggcagcgacccgagtcgggccgccgcgcgcgggggtattacacgagccccgtcatgtagtacacggcgatcacgaagaacaccgcgagcgtcttgatgatcgtgaccgcgaagatgtcgcgatacgactcgcggtgcgtgaggcccgtgaccgcgagcagcgtgatcaccgcgccgttgtgcggcagcgtgtccatgccgccgctcgccatcgcgacgacccggtgcagcacgtccagcgggatattggcggcctgcgcgcccttgatgaacaggtccgacatcgcggcgagcgcgatgctcatgccgcccgacgccgagcccgtgatgccggcgagcgagctgaccgacacggccgcgttgacgagcgggttcgggatgctcttcagggcatcgctgacgacgaggaagcccggcagcgccgcgatcacgccgccgaagccgtattccgacgcggtgttcatcgcggcgagcagcgcaccggcgacggcggccttcgagccggctgcgaagcgcccgctgacgcgtttgaacgcggtcagcacgaccagcacgatgccgagcagcagcgccgcctcgaccgaccagatcgcgacgacggtcttgatcgacgtcgtgaccggcgcgtgcacgccgggcagcacttccggcgcgaccgtgtacgacgcggcgccgtaccactgcggaatcagcttcgtgaatgcgaagttcgacacgccgacgaggatcagcggcaggatcgcgagcgcgggattcggcagcgacttcgcctcgacgcgctccggttcgttgacgagcgacgtgccgtagccttcaccctttgccatcgcagaacggcggcgccattcgagatacgagaggccgacgacgatgatgaacagcgagccgatcgtgccgagcgcgggcgcggcccaggcggtcgtcttgaagaacgtggtcgggatgatgttctggatctgcggcgtgcccggcagcgaatccatcgtgaacgagaacgcgccgagcgcgatcgcgccgggcatcagccgtttcgggatgttgctctggcgatagagttcggccgcgaacggatagaccgcgaacaccacgacgaacagcgacacaccgccataggtgagcagcgcgcacaccgcgacgatcaccgcattcgcgcgtgagcggccgatgtagcggatcgccgcgtggacgatcgactcggagaacccggagagttcgatcaccttgccgaacaccgcgccgagcatgaacaccgggaaatacagtttgacgaatccgaccatcttctccatgaagatgccggagaagaccggtgcgacggcggcgggttcggtcaggagcaccgcgccgagcgcggcgatcggcgcgaacaggatcacgctgtagccgcgatacgcggcgaacatcaggaacgccagcgcggcgaggacgatcacgaaagacaagggagtctcctaatggctttggttgttgttcgatcgcgcgatgcgccgcggaccggctcaggttcgtgcaggtttcgtgccatcggccggatagcgccgccggacatgggtccgccggggaccggcgggcccgcgccggtcgttgtctgacgattctacataaaacgtctccatccggagacgaaatggccgtccggccagcccgtggaatcgggcagggctttcccgggcaacgcattgcggcgtgtctccggagtgagataatccgtctcgttccggagacagccggtcgacaatacacggagacgaagacacgatgatgaacgactgggcccgcctgcccgtcaactacggcgacgtgctgcggcgcgccgccgagtcgctgttccggaccttcgaggattcgagcgcgggcacggtggtcgtcgatcgcgatgcacgcgtcgtgtggatgaacgagcggtatgcggcgcgcttcggtttcgccgatccgcaacaggccgtcggcctcgactgcgaggccgtgatcccgaacagcctgatgcgcgaggtcgtgtcgaccgggcagccgatcctgctcgacatcatggagacgggccgcgagccgctcgtcgtcacgcgcctgccgctgaagaacgaggccggcgagacggtcggcgcgatcggcttcgcgctgttcgaccagttgaagacgctcacgccgatcttttcccgctacgcccagcttcagcagcaactgatcgcgacgcagcgttcgctcgcgcaggtgcgccgcgcgaaatacacgttcgcgagtttcgtcggcacgagtgcggcgagtctcgaaaccaagcgccaggcgcgccgcgccgcgcaggtcgactcgccggtgctgctgctcggcgagacgggcaccggcaaggaactgctcgcgcatgcgatccacgcggcgtcggcgcgtgcactccagccgctcgtgaccgtcaacgttgccgcgattcccgatacgctgctcgaaaccgaattcttcggcgcggcgcccggtgcgtatcgggcgccgaccgcaaggggcgcgtcggcaagttcgagctggccgatcgcgggacgctgtttctcgacgagatcggcgacatgccgctgccgctgcaggcaagctgctgcgcgtgctgcaggacaaggagttcgagccggtcggctcgaaccggatcgtgcgcgcggacgtccggatcatcgcggccacgagcgccgacctgccggcgctggtcgcggccgggcgttttcgcgcggatctctattaccgtctgaacgtgctgacgatccacgcgccgccgctgcgcgagcgcgcctccgacatcgcggcgctcgtctacgcgaccctcgaggaactggctgcgcaacacgggcgcgcggcccattgcgaactgaccgacgatgcgctgcggatgctgtgtgcgtatccgtggccgggcaacgtgcgcgagttgcgcaatacgctcgagcgcgcgctgatgctgtcggaccggtcggtgatcgatgcgcgtgcgctcgcgccgttccttgggccggtgcgcgtatcgacggacggtgcagtaccggcgcagccggtggccgtgtcgacggtcgagcggcgcacgggcgaaatgcgggctgcgccggcagcgtcgtatgccgatgcattggcggcgtgggagcgccagttcctgaccgacgcgctcgcggcttgcgacggcaaggtggtggaagcggccgcgcgcatcgggatcggtcgcgcgacgctgtacaagaagctggcggcgctgggcatcgaccggtaggccgaccggcaacgccgatgcggccggacgtgcggcatcgaacaggagagcacgatgaaacggatcggcatcgcaggatggctgacgctgttgctggcgagcgccgcgctcgcgcagtccggcgacgccgacgcgcccgggcgcggcgcaactggtacaacgatccgttcatcgcgctgtcgcgggacgtggccgaatgcccgttgccgctcggcccgtggatgacccgggccgagatgacggacgacgcgcattaccgtgccgaacgcggcaccacgtgctggctcgcgcaccgttgcacgaagccgaactcctacatgtatgacgcaccgatcgccgacgccgtgaaggcacacttcgccggctccgatcgactgcatggcacgagcctgtggatcacggtgcagcggcgtttcatttacgtcgaaggatgtgccgatacggcgttcgaccggcaggcattgcagcgtgagctcgaggcgattccggacgtcgagcaggtgttcgttcgcatcaccgacgatccgcgcaagcgcttgccgtacaaggcgcgcgggcaacccggccgcacgccgaactgacggagaaagggccgcgcatggcatactcgcgacattcaaaaaggttgacgggaagaacaatgaaacacatgcttgcgtcggtctgtcggtggcctcgggcggccgttgtgctgggtctggtggccgggctcggcgggtgtggcggcagcgcgccgctgttcacttcggacgggcgtccgactacccaggtgcaatgcaccggcagcgactggagcaattgcacggacaatgcccgggcgatctgcaacggggatttcgaagtgcttcagcaatcgagcgatgacgccacgcgaaatcttctcttcgcgtgcaagaagaagagcggttattgacctcgagataaccggctggggagaccacgatcgggcgaagcgcttttctgtttgctgagagtcacctatttttcacgaataacactcacggagtcccatccatatggcgacctacaggcaactgaccgcgcagctcgaacggcttcagcaaaagatcgacaaggaacgcgaaaaggcgattgccgatgcgattgccgatatccgcgcgaaaatcgaggaatacgacattacgccggaagagctcgggttccgtgcggcagggggccgctgccgccgcgaagccgaagcgtacgtcgccgccgaagtacctgaacccgaagacgggtgaaacgtggagtggccgtggacggtcgccgacgtggctcggcaagaatcgcgcgcgtttcctgatcaaggactgactcccgaaaattctcacctttcgcgtgccgaccgacggtgcgaacggccatgcggccgtcgcaccgttttgtttttgtgcattcccggcgcgatttccgacggcgtattgaactgcgatgccgcgcaattaacggatcccgttttgcgaattcgctgcgattcggctgcatatcgcggcgattttcggtaaacagcgccgcaatttcacggcgcatccgcattggctcgcgccattctcgcggtgcacgcgcgccgcgaattccgatcacctttcgcgtgtttgcgcgtcgcgccgtgcaattcccgaatttactcaccatagctcctgtaaatcctcacctttgacgaagcggacacagcgccgcgccgaatgcgaacgccggctgcgtcgagcgaatgtggacgcccggcgcgcggcgacggctttcgtgctcgtgtcacaggcccatggtgcgtgcgttgacgtctgtcgaatagtcggccgtccggcatataggcagccgcatgcgcttcgcctatgcttggggttcgcgtcgatcggtgtatggcctgtccgtgccgcatgccgatcgggtcgtctttcgttaccgcagggagccgatgtgaccgttcgccatctcgatgcgttgttccagcccaagtccgttgcggtcgtcggcgcgtcgtcgcgcgcgggcagtatcggtgcgatggtgtggtcgcgcgtgctcgacggcgcgttccaggggcccgtgtggcccgtcaatccgaagtatcgtgacctgcacgggcatgcggtcgttgccgatgtcgaccggttgcccgcaccgccgtcggttgccgtgatctgcacgccgcccgcgacctgggccggcatcgtgcgcaagctcggcgagctcggcacgcgcgtggcggtgatcgtcggcgaggcgcgcacggatgccgatcgcgccgcgctcgatcgcacactgaaggcggcgaagccgttcgtgctccgtatcgtcgggccgggcagcctcggcgtgctgtcgcccggacggcatgcccatttcggcgcgccggcctatacggcgcgatcgggcggtgtcgcgtgggtgtcgcaatcgaatgcgctgacgaacgcggtgctcggctgggccgacgcacggggcctcggtttttcgcatgtcgtcgcgctcggcagcgagtccgacgtcgatgcgggcgacgtgctcgactatctcgcgagcgaccccggcacgcgcgcgatcctgctcgaactcgataccgtgcgcgcggcgcgcaagttcatgtccgccgcccgcgcggccgcgcgcaacaagccggtgctcgccttgcgcaccgggcgcgccgatcccggcgacgcgctctatacggcggcgttccagcgcgcggggatggtgcgggtcgatgcgctcgacgacctgctcgacgagatcgagacgctcggcgtcggccgcgtcacggcgcgcggcgcggccacgctcgtgacgagcgatgccggggtcgcgaaactcgcggtcgacgcggtgtccgacgtgcgcgacgtactggccgactggccgcccgccgccacgtcggccgtctcggccgcgctgccgcatctcgcgttgcccggcaatccgctgacgctgggcgacgatgcgcggcccgagcattttgccgcggcggtcaaggcgctcgcgccgttcccgcaaacgggcacgctgttcgtcgtccattcgacttcccacagcgcgccggccgacgcggtcgcgcacacgctgatcgaagcgcggcagtacgcgcatcgcggcatcctcgcgtgtttcttcggcgcggtcgacgcggcgacgcgcgatgcattgcatgcgaacggcattcccgtgcacaccacgccgcagcggctcgcacgcgcgtatgcgcgtctcgtcgactacaacctcgggcggcaactgctgatgcaaacgcccgagggcacgccgttgcagccggccgagtgcgttgcatccgcgcaggccgacgcgcgccggatggtcgaagccggcgagcatgagctgaccggcgaagccgcgctgggctggctgtcccgtttcggcctgcagggcgagcaggccgccgagccggccggcacgaaagtcgtcgatgtcacggtcgacatgtacgacgatgcgaacttcggcccggtgtttcgctatgccgtgccgcccgcggacggcgtatcggcgccgttcgtcgtctatggcctgccgccgctgaacaccgtgctcgcccgcgcggtgatggaacgctcgccgtatgcacgccgcacacccgtcgagccgacgctcgacgcattgacggcgctgtcgcaggtcgtctgcgacgtgcgtgaagtcgttgcgatgtcggccacgctgcgcgtgctgtccgaccgtgcgcaagtgattgcgccgcgtatcacgctggccacgggccgcagccggctcgcgatcatgccgtatccgcgccacctcgaacagacgctcgagtggcgcggcgagacggtgacgatccgcccgatccgtccggaagacgaggccgcgcacaacgagctgctcggcgcgatgacaccggacgatctgcggatgcgattcttcggtgcggtgcgcagcttcgatcattcacaggtggcgcgcatgacgcagatcgattacgaccgtgagatggccttcatcgtgtcgttcaccgatgtgtccgggcgcgaccacacgctcgcggtggcgcgcgcggtggccgatcccgacaacgagacggcagagttcgcgatcgcggtacgacccgaccagaagggcaaggggcttggccggctgatgatgaaccggatcatcgactacgcgcgttcgcgcggaaccgcatggatgatcggcgaggcgctgcgcgagaactcggcgatgatcgcgcttgcgaagtcgtgcggtttcgccgtgtcgacgacggaggagcccggtgtcgtcggcttcaggatgaagctgcagccgtagcgtccgtcggcggctcggcgcgcacggacgccgtatgccgtcgatgtccccggcttcccggcacgttgcggatgtttccggtcacgaatgccgggcattcgaaccggtctcgcgagcgaaacaacggcgaacgtgtcgctgcctgttcgcgatggaaacaacgacacgcatgcggcaggcatcgcgagacgcgtttcgtttgccgcgatatccgtcgcgcgtcgtagtgttccgcgcgatgttcacacgtatttgccgccgtatttcagcctcgaaaattcgagcctgcccaaacggtgagatttttcaggagccaccggtgagcttctccaggatggtcgaggtgagccgatacgggagcattcggtgagccttccgggagtggccggtgagtacctgcgggaggcgtcggtgagcctttccggggcgcatcggtgaggggctgcgggacgtgtcggtgagcacatccgggagccttcggtgagggtttccggagccttggtgagctttttcgggaggtgtgggtgagcgcttgcgggacgccagggtgagacttttcgggagtatccggacgcacggcctgcgcaagcgcaacgccggccaaggtcggcgttgagcaggggcgggcacgcatgaaccgtgcccgcgcttacattcaggcagcgagtttcgccgccgcgtcgttcacctggtcgcgcgaaatcgcgagttcctcgaggtgcgaatcggcatagacggcgccggtttcgcgctcgaggcgggcgatcgtcagcgcgcagcgcgcgatgtccttcggcatcgcgatgaagcgcttgaccgattcgccggacgtgaatgcttcgaacagcgcgccgcgcacgtcgtccggaagcgtcttggtccactggtacggcttgccgttgaacgtgatcgacggcggcagcgtgcgttccttcttggtcgccgtgatgagcccgtaggtgcgggctgcgtcgccgatctgctcgggcgagaagagctcgtcgggcgtgatgtcgaactgctcgatgtagttctcgatcgcctgcatcgcggcggcacgatcgtcgcgcttcttctgcgcgcgcgacgatatcgcgcagttcgtccgcctcctcgggcgtgatcgtgaagcttgcctgcttctgctgaagttcggagaaacgctggaattcttgatcgttcagaagtttggccatgacatccatcggacacgacggccgcgacaaccggccgccgtagttttgagagggccgctattttagcgtagcgccgtggacgcacgatatggcaccgtgcgtcgcgcctcgcaccggcgtgattgcgggcgaccgggatcggcgcaatcgcgccgtacccggtgcgttccgacgagcctgcgtgtcggcagggtcagcagtgtcagcaggtttcggtgcggcacatcgacagatgggcggccgtttcgcgcaacccatcgacgaccgcgtcgaccgacggcgccatgtgcgcatcgatccggcgcatgtacgggcaggtcagcaccgcgatcgcatggccggacggcccgaggatcggcgcggtcaggtcggtcacgccgtacgcctggcggctgtcctggcgcaggtagccggcctgccggatggactggcacgcgtacgcgagttcctgctcgttcagcggcgcttcgcccttgaccttgcggtgctccgcgagcatgtgcgcgcgctgctcggcgccctggaacgacagcatcacccgccccgatgccgtatcggcgagcccgatgcgtgagccgagccggaccgacacaccccacgggccgggcccgtcgacttgcgcgatcacgagcaggttgccgcgatcgtagacggacaggtggcacgattgttccgaggaatcggcgaagcgctgcatcggcggcagcgcctcggcgatcagccggctcatcggcggatgccggtgcgcgagcgagaacagcttgaggctgagcgtatagcggtcgccgccggtcgagcgcatcacgtagcggcgcgcgacgaggcgttcgagcatccggtagatctcgctcgcgttgcggccgagttccttcgtgatttcggtgcgggtgaggccttctttctgctccgacaggagttcgaggatgtcgagacccttgtcgagcgcgggtgcgcgataacggtcgattgcgcccatcgattcccgtgcgtcgcagccgggaagcaggtcgttggttgtttgcattgtcgatgtgaggttggggattactgtcgatcgattggcgacgcacgctgaccgattctgcacttcgcctgtgtcgggctcgcgtgtggcgacgcacgccatccgtccgagcttaacaacaaacatttagtgtgcaatgcagcgtctttttaccgatcgttacctaacaagaacggatcaatttgttttcaggatgacaggaagctccgaatacccggtattcatgacaggtggcaccggttcaaggtattcgaaaggaaatcgggctgcgccgccgcccgcgatgctgcgccgcagcgcccgcgggcgcaccaatagtcggtatccgtcgcgcgtcatttcatcgtgcgcggccgatggtacaaagactggcgggccagcgacggtgcggccgcgcgtgacgccggccggtacgggccgggccatgtcgcgggtgccgggccgtcgtcgccgatgcgcagaccggcggccgcccgttcgatgcgcgccatacttccgtgtggcgccacgatcgctgcgcccgcgcgaccctcgcgcgtcgaacggcatgccggatgcggcgccgacgcgcgcaatcgacgatcgacaatcagtccggcacgcggccgcaaagagcggcgtcggccggtatcctgtcctattcgacaacagaggttgagcacgatgaaactgcttcgttatggcccgtccggccaggaaaagcccggtattctcgacgcggccggccggattcgcgacctgtcggcgcatgtgccggatctgtccggcgatgtgctgtccgacgcgggtctcgcgcgtctgcgtgcaatcgatccggccacgctgccgctcgtgtcgggcgagccgcgcatcggcgcgtgcgtcggccacgtcggcaagttcatcggcatcggcctgaactacgccgatcacgcggccgaagccggcatgccggtgccgaaggaacccgtcgtgttcggcaagtggacgagctcgatctgcggcccgaacgacggcatcgacatcccgaagggttcggtcaagacggattgggaagtcgagctgggcgtcgtgatcggcgcgacctgcaaggacgtcgacgaagcgcgcgcgctcgattacgtcgcgggctactgcgtcgtcaacgacgtgtcggagcgcgaatggcagatcgagcgcggcggccagtgggacaagggcaagggtttcgacacgttcggcccgatcggcccgtggctcgtcacgcgtgacgaggtgcccgatccgcagcgtctcgacctgtggctcgaggtcgacggccaccgctatcagaacggcaacacgcgcacgatggtgttcaccgtcgcgcagctgatcgcctatctgtcgagctgcatgacgctgcagccgggcgacgtgatcacgacgggcacgccgccgggcgtcgggatgggcatcaagccgtcgccggtgttcctgaaggccggccagacggtgcgcctcgggatcgacgggctcggcgagcagttgcagagcacgcgcaacgcgcagtaagcacgtccccggcgcgggcggatcgcggggcaatcagccgcgagccggccgcgccgcccggcatcggcatgcttgcctgcggcgagcgtcgcgaccgaacctcgatgcagcaaaaacaggacaagggcccgattccgcgcgatgcggaatcgggcccttgtcgttcacccgcgtcggtacgaaccggatcagacgacgttgtccagctcgcaatgggcttcgagccgatatccgtcgggatcgacgacgaacgccgcgtaatagccggggccgtagtgctcgcgcttgccgggcccgccgttgtcctggccgccgtgctcgagcgcggcgcggtagaacgcgtcgacctcgacgggcgacgcggccttgaacgacaggtgcagcccggagtcgggatcggcggcgatggggcgagccgcatgttgcagccacagcaccggctcggtctcgccgtacccgatcgagccgtcgtcgctatacagccgcttgtagccgagcgcgccgagcgtgctgtcgtagaacgtgcggctgcggccgatgtgggcaacgccgaaggaaaggtgatcgatcatctgtgggctccttgaactgaagaggggacgtcagtacggcaaagctgcctacaagcaccatgccagccgcttgtagcggagcgcaccgagtgtgctgtcgtcgaacacccggctgcggtcgttgtggataacgctgaaaaaaggcgatcgatcatctgtgtctccttgaactgaaagggcgcagtgcagccaaccgtttttaaccaccatgccggttatgttagaaagcgtccggatgcttgtcaaccggcatgctggttagatacgatcgcgtcatgagcaaaacgcaaccttccgtcacgacggactgcctgattccggcgccgccggaaacgctgagcatcgatttcgcaaacacgctgtactggcgcggcgccgacacgccgacggagaccttcgggacgctggacgacctgttgacctggtgccgcgagcaggcgggcgtaccggccggcctggccgacgcgtgtcgagtgcgggacaaggatgacgagccggcgatgctcgcgcgcgcgcactgcgcgaggcgctgtatcggctgtttcatgcgcaggccgagcagcgcgagccgcacgccgacgatctggcgctgctcggcggcttcctggcggaagcggcgccgcgcgtcgcgctggcgcgcatcgacggcgcctatgcgtggcggatcggcggcgcgggcgccacgctcgcggcgctgctgagcccggtgctgtggtcggcgatcgacctgctcggcggtgcgcggctcgcgaaggtcaagcgttgcgcgaacgacgcctgccagtggctgttcatcgacgacagcaagaacggcagccgccgctggtgttcgatgtcgtcgtgcggcaatcgcgcgaaggcgtaccgccactatcgcaaggtcgactgacgttcctcgttacgcaggtgcgcgccggcgcgccgcatccggcctgcctatttcaccgacaacttccgccacagcgtcgtcttgctgatgccgagcatcgcgcatgcgcgatcgcggtcgccgccgcacgcgtcgagtaccgcgcggatctcgtcggcttccgcgcgccggcggcgtgcgtgcagcgtctgcgcatcgtcggcgtcggccgcgtcgggcggggccgcgaacagctcgggcgcgatcgcctgcagcgcgtcgggatcgagcgtgccgcaggcggcggccggatcgttttcgtcggcttcctcggccagctccaccgcgatccgctcgatcacgttctgcagttcgcgcacgttgccgggccaccggtagcgcgtgagcccggcctgcgtcgcgccgagcacgcgcgcggcgtcgtcggcgtcgcgcaggcgctcggcgagccgcggttcgcgtcgtgcggcctgcacgagcagcgtggccgcgagcgccgggatgtcggctgcgcgctcgcgcagcggcggcaggccgacgttcaggatgttgagccggtaatagagatccgcgcggaacgtgccggcctcgacggcggcgagcagcggacggtgcgtcgcggcgatcacgcgcacgtcgatgcggatcggctcggtcgagccgaggcggatcacctcgcgctcctgcagcgcgcgcagagccggctctgcagcgacggcggcatctcgccgatctcgtcgagaaacagcgtgccgcggtgtgcggcttcgaacaggccggtcttgccgccgcgccgcgcaccggtgaacgcgccttcctcatagccgaacagctcgctttcgagcagcgcttccggaaacgcgccgcaattgaccgcgacgaacgggtagctgcgccgcgcggacagcgcgtgcaggctctgcgcgatcatttccttgccggtgccgctttcgccgagcacgagcacggtcgcgtcggatttcgcgtagcggcgcacgagatcgcgcacgcgcgccatcggtgccgatgcgccgaccacgtcgtcgagcgcgtagcgcgccgcgaactgctgcgtggtgggctgcgaacgcagtgcgcggtcgagccgttcgaccgcgcgcgattcctggaacgtcagcacgctgcccgacgtgacgccgcgatcgacgagcggcccgcgatgcacgacgtagcgcacgccgcgcacggtcgcgagcgcgtcgccgtcctcgccgcgcagcgtgcgcagctcgggccgcaggtcgacgagcgcgcggccgacggccgccgcgggttcgaccccgagcgccgacgcgagccgctcgttgatcgcctccacgcggccgcgcgcgtcgagcgcgaccacgccgtcgcgcaggtgctggagcaggttgtcgagccgctggcggcggaacgcctcggcatgcgtcgcgtacgcgacttcgagcgccgtatcgacggccttgcgcaccgacgcgtgcgaatacaggaacaccgcgcccatgccggcgctggccgcgagatcggtgacgaggccggggccgacgatcgtctcgatgccgcggtcgcgcagctcgtgcacgcaggcttccgcttcctgcgcggactgatatgacgcaaactgcacgtcgaggccgtatgcggcgacgaagcggcgcacttcgggcggcgtttcgccggcgctgacgagcgcgatccgcgacgcgtcgcgccgggcgcgcgcgagcgcctgcatcacgtcgaagccggtcggcgacacgaccaccaccggcacctgcgcacgcgtcttcaggaagccgccgttcgagccggccgcgacgatcacgtcgggccgcgcggtgccggcctcggcgatcgcgctgagcgcatcctcataggcgcgcgtcacgatgcgcacgtcggcgcgttcgtcgaattcgccggcgatctcgcgaaagagttcgcgcaggcggctgatgcccatcgcccagatgcgcgggcgcgccgcgcgatccgccgggccgacgggcttggtcgaagagaggtccatggcggtcgattatgcgcgcgcgatttcattttgaaacatgaaattgctgaattgaaatcgccgggtgcggcatcgcccgtgccggttgcttaagaatcagagggttagcgacattccgcaagctggcccggtccttgctgttatcgggcattccatcaggaggccgttcatgagcaacacgcatcttcagagcgccggcgcgaaattccgcgcggcagtcgcggccgagcagccgctgcaggtggtcggcgcgatcaccgcgtacgcggccaagatggcgcaggccgtcggcttcaaggccgtgtacctgtcgggtggcggcgtcgccgcgaactcgctcgggatccccgacctcggcatcagcacgatggaagacgtgctgatcgacgcgaaccggatcaccaacgcgaccgacctgccgctgctggtcgacatcgatacgggctggggcggcgcgttcaacatcgcgcgcacggtgcgctcgttcatcaaggccggtgtcgcggccgtgcacctggaagaccaggtcggccagaagcgctgcggccaccgtccgggcaaggaagtcgtgccggccgacgaaatggtcgatcgcatcaaggccgcggtcgacgcgcgcaccgacgatcaattcgtgatcatggcgcgcaccgacgcggccgccgccgaagggatcgattcggcgatcgagcgcgcggtggcctatgtcgaggccggcgcggacatgatcttcccggaagcgatgaagacgctcgacgactaccgccgcttcaaggcggccgtgaaggtgccgatcctcgcgaacctgaccgagttcggctcgacgccgctgttcacgctcgacgagctgcgcgaggcgaacgtcgacatcgcgctgtactgctgcggcgcgtatcgcgcgatgaacaaggccgcgctgaacttctacgagacgctgcgccgcgacggcacgcagaaggcggccgtgccgacgatgcagacgcgcgccgagctgtacgacttcctcggctatcacgaatacgagcgcaagctcgacgagctgttcgcgcagggcaagaagtaacgcggcccgcgcgccgggcacgattcccggcatgccttgcatgaaaccgggccgcgcgcacccgtgccgcgcccggcggacatgacacccacgatacatattggagaacggaaagatgagcgagacgaaagacgcagcagcaccggccgccgcaggcgttcaagccgaagaaatcggtggcgctgtcgggcgtgacggccggcaacacggcgctgtgcacggtcggcaagaccggcaacgacctgcactatcgcggttacgacattctcgacgtcgccgagtcgtgcgaattcgaggaaatcgcgcacctgctcgttcatggcacgctgccgaacctgaccgaactggccgcgtacaaggcgaagctgcgcgcgctgcgcggcctgccgaacgcgctgaaggccgcgctcgagcagatcccggcatccgcgcacccgatggacgtgatgcgcacgggcgtgtcggtgctcggcaccgtgctgccggagaaggacgaccacaacctgccgggcgcgcgcgacatcgccgaccgcctgatggcatcgctcggttcgatgctgctgtactggtatcacttctcgcacaacggcaagcgcatcgagacggaaaccgacgacgactcgatcggcggccacttcctgcacctgctgcacggcaagacgccgtcgaagtcgtgggtcgaggcgatgcacacgtcgctgatcctgtacgcggagcacgaattcaacgcgtcgacgttcaccggccgcgtgatcgcgggcacgggttcggacatctactcggcgatcaccggcgcgatcggcgctgcgcgggccgaagcacggcggcgcgaacgaagtcgcatatgaaatccagagccgctacagctcgccggacgacgccgaagccgatatccgccgccgcgtcgagaacaaggaagtcgtgatcggcttcggccacccggtctacacgatctccgatccgcgcaacaaggtgatcaagggcgtcgcgcacaagctgtcgaaggaagcgggcgacctgaagctgtacaacatcgccgagcgcctcgaatcggtgatgtgggaagcgaagaagatgttcccgaacctcgactggttcagcgcggtgtcgtatcacatgatgggcgtgccgaccgcgatgttcacgccgctgttcgtgatctcgcgcacgtcgggctggagcgcgcacatcatcgagcagcgcatcgacaacaagatcatccgcccgagcgcgaactacaccggtccggaagacctgcagttcgtgccgatcgagaagcgctgaaatgcctgccgcgcgcgccggcgcccgtgatgcgggccgccggcgcgcgcggaacgtcttaccccgaattccgccccacatcatgaataccgccaaccgcaaacccctgcccggcacgtcgctggactatttcgacgcgcgcgccgcggtcgacgcgatcgcgcccggcgcctacgacacgctgccgtacacgtcgcgcgtgctcgccgaaaacctcgtgcgccgttgcgatccggcgatcctcgccgattcgctgaagcagatcatcgagcgcaagcgcgaacgcgacttcccgtggttcccggcgcgggtcgtgtgccacgacatcctcgggcagacggcgctcgtcgacctcgcgggcctgcgcgacgcgatcgccgatggcggcggcgacccggcgaaggtgaacccggtcgtgcccgtgcagctgatcgtcgaccactcgctcgccgtcgagtgcggcggcttcgatccggacgcgttcgcgaagaaccgcgcgatcgaggatcgccgcaacgaggatcgcttccacttcatcgagtggacgaagaaggcgttcgagaacgtcgacgtgatcccgccgggcaacggcatcatgcaccagatcaacctcgagaagatgtcgccggtgatccaggcgcaggacggcgtcgcgtacccggacacctgcgtcggcaccgacagccacacgccgcacgtcgacgcgctcggcgtgatcgcgatcggcgtcggcgggctcgaagcggagaacgtgatgctgggccgcgcgtcgtggatgcgcctgcccgacatcgtcggcgtcgagctgaccggcaagcgccagcccggcatcaccgcgaccgatatcgtgctcgcgctgaccgagttcctgcgcaaggaaaggtggtcggcgcgtatctggaattccgtggcgaaggcgcggcgagcctcacgctcggcgatcgcgcgacgatctcgaacatggcgcccgaatacggcgcgacggccgcgatgttcttcatcgacggccagacgaccgactacctgcgcctcaccggccgcagcgacgagcaggtgaagctcgtcgagacctacgcgaaggcggcgggcctgtgggccgatacgctgaacgatgcgcagtacgagcgcacgctgacgttcgacctgtcgagcgtggtgcgcaacatggccggcccgtcgaacccgcacaagcggctgccgacgtccgacctcgccgcgcgcgggatcgccggccagtgggaagagaaggcgggcgagatgcccgacggcgcggtgatcatcgccgcgatcacgagctgcacgaacaccagcaacccgcgcaacgtgatcgccgcggccctgctcgcgcgcaacgcgaacgcgaagggcctcacgcgcaagccgtgggtgaagagctcgctcgcgcccggctcgaaggcggtcgagctgtacctggaagaagcgaacctgctgcccgaactcgagaagctcggctttggcatcgtcgcgttcgcgtgcacgacctgcaacgggatgtcgggcgcgctcgacccgaagatccagcaggagatcgtcgatcgcgacctgtacgcgacggccgtgctgtccggcaaccgcaacttcgacggccgcatccacccgtatgcgaagcaggcgttcctcgcgtcgccgccgctcgtcgtcgcgtatgcgatcgccggcacgatccgcttcgacatcgagaaggacgcgctcggccacgacccggacggcaagccggtcacgctgaaggacatctggccgaccgacgaggagatcgatgcgatcgtcgcgtcgagcgtgaagcccgagcagttccgcaaggtctacgagccgatgttcgcgcgcagcgccgatgcgggcgagcgcgcggcgccgctgtacgactggcgcgcgcagagcacgtacatccgccgtccgccgtactgggaaggcgcgctggccggcgaacgcacgctgcagggcatgcgcccgctcgcggtgctcggcgacaacatcacgaccgaccacctgtcgccgtcgaacgcgatcctgctcgatagcgcggccggcgaatacctcgcgaagatgggcctgccggaagaagacttcaactcgtacgcgacgcaccgggagaccacctgaccgcgcagcgcgcgaccttcgcgaacccgacgctgatcaacgagatggcggtggtcgacggcgcggtgaagaagggctcgctcgcgcgcgtcgagccggaaggcaaggtcatgcggatgtgggaagcgatcgagacgtacatgaatcgcaagcagccgctgatcgtcgtggccggcgccgactacggccagggctcgtcgcgcgactgggccgcgaagggcgtgcggctcgcgggcgtcgaggcgatcgccgccgaaggcttcgagcggatccaccgcacgaacctgatcgggatgggcgtgctgccgctcgagttcaagcccggcacgaaccggacgacgctcggcatcgacggcaccgaaaccttcgacgtgatcggcgagcgcacgccgcgtgccgacctgacgctcgtgattcaccgcaagaacggcgagcgcgtcgaggtgccgatgacgtgccggctcgatacggccgaggaagtgtcgatctacgaagcgggcggcgtgctgcagcgcttcgcgcaggacttcctcgaatcgtcgcaggcggcctgacgggcctacggagagaacacggacatggctcacattcctcaaatcagggttcccgcgacctatatccgcggcggcaccagcaagggtgtgttcttccggctgcaggacctgccggacgccgcgcaggcgccgggcgccgcgcgcgacgcgctgctgctgcgcgtgatcggcagccccgatccgtacggcaagcagatcgacgggatgggcggcgcgacgtcgtccaccagcaagacggtgatcgtgtcgaagagcacgcggcccggccacgacgtcgactacctgttcgggcaggtcgcgatcgacaaggcgttcgtcgactggaccggcaactgcggcaacctgtcggcggccgtcggcccgttcgcgatcggcggcgggctcgtcgatccgtcgcgcgtgccgcgcgacggcatcgcgaccgtgcggatctggcaggcgaacatcggcaagacgatcgtggcgcacgtgccgatcgtgaacggcgcggtgcaggagacgggcgacttcgagctggacggcgtcacgttcccggccgcggaagtgcagctcgaattcatggacccggccgccgaggaggaaggcgcgggcgggtcgatgttcccgaccggcaacctcgtcgacgatctcgcggtgccgggcgtcggcacgctgaaggcgacgatgatcaacgcgggcatcccgacgatcttcgtcgaggcggaagcgatcggctatacgggcaccgagctgcaggacgcgatcaacggcgatgcgaaggcgctcgagaagttcgagacgatccgcgcgcacggcgcgctgcgcatgggcctgatcgacacgctcgacgaaatcgcgacgcggcagcacacgccgaagatcgcgttcgtcgcgaagccggccgattacgtcgcgtcgagcggcaagcgcgtgaacgcgggcgatgtcgacctgctggtgcgcgcgatgtcgatgggcaagctgcaccacgcgatgatgggcacggcggcggtcgcgatcggcacggccgcggcgatccccggcacgctcgtcaacctggcggcgggcggcggcgaacgcaacgcggtgcgcttcgggcatccgtcgggcacgctgcgcgtcggcgcggaagcgcagcagcaggagaacggcgagtggaccgtcaccaaggcgatcatgagccgcagcgcgcgtgctgatggaaggctgggtgcgggtgccgggcgacgcgttctgatcgtcgccggcggtatcggcgcagatgcgggcggcttcggccgcccgcgtcgttttcgtcagccgtgcaggaagcggcgcagcgcgtcgtggctcaggcggcgcgccgtttcggcgatgcgcgcgccgggcacgatgtcgaaaccgtgcacgccgccgggcagcacgtgcagttcggtcggcacgcccgcgcggagcaggcgccgcgcatagtcgaggttttcgtcgaggaacaggtcgagcgagccgaccgacaggaacgcgggcggcaggccgtcgagccgcgtggcgcgcgcggcggccgcgtagggcgatacgtcgtcgatgcccggcgcgtgaccgagcagcgaggtccagccgaaccggttgttggccgcgtgccagacgaactcgccggcatgcgggtgcggcgtgcgcgtgcaggtgcgatcgtcgagcatcgggtagatcagatgctggaacgcgagccggtattcgccgcggtcgcgggccagcagcgccagcgaggcggcgagtccgccgcccgcgctctcgcccgccacgccgatccgcgacgcatcgatgccgagcgtatcggcatggcggaagacccatgcgagcgccgcgtagcaatcctcgatcgcgcccggaaacacggtttcaggcgcgagccggtagtcgatcgagatcagcgcgcagccgagctgcgtcacgagtgaccggtgcaccgcctcgagatccttcgccttgccgcgcacgaagccgccgccatgcaggtgaacgatcgccgggagcggccgcacgtgatggtcgggcaggtagacgaggaccgggacgtccggcgcaccggcggggccgggcaccgtgcggtgttcgagcgtgctgccggccaggtcgggcggcggcagcggcagcacgcgttcgcgcgactgcgcgaggttgtcgatgccgagcgtgacggtcggccaggtctcgagcagcgggcggatttcagggtcgacgagatgcagggtgtccaacgcatggctccatcgtgaaggtgggcggtgcaccgcggtcagagcgcgctgcgcgcgatgacccagcggtgcacctcggtcgggccttcgaagatgcgcatcagccgcgcttcgctggccatctgctgcaacggcatttccttcgtcatgcccatcgcgccgagcgcctgcatcgcatgatcgatgacgctcgacgccatttcggtggcgaacaccttgaccatcgagatctgcgtgcgtgcatcctggccggcatccacgcgcgcggccgcttcgtaggtcatgaggcggcacgcgtggatctgcgtgagcgcgtcggcgacccaccactggaccgcctggcgttccgcgagcggcacgccgaaggtcttgcgctgtttcgcatggtcgcacagcatcgcgaccgcgcgctcggcgcggccgatgcaccatgcggccatctccagccgccggttcgcgagccgtgcctgcatcggcgcgaagccggcaccttcctggcccagcagttgcgcgacgggaatgcggcagtcgtccagcacgatttcgtaggtcgacagcccgccgatcatcgggatccgccgttcgatgatgaaaccgggcgtgccgcggtcgacgatgaatgccgacatgccgccgcgcttgcccttgctccgatcggtgagcgccatcacgatcgtccagtcggcttcgggcgcgtggctgatccagatcttccgtccgttcagcacccagccgtcaccgtcgcgcacggccgtcgtcgacagcgcgcccgggtccgagcctgcgcccggctcggagatcgccatcgcggcacgcgtgacgccgcgtgcgtacggttcgagataacgcgcgcgctgcgcgtcgtcggccacgtcgcacagcatccgcaggttcggcgaatcgggcggcaggatgtacggcgtcacggtcgtgccgatcgcttcgttgacgccgaccatcgcgacggccggcaggtccgagccgccggcgtcgagcggcgcgtcgaggccccacaggccgagctgccgggaacgctcgtcgaggtgggcgcgttcttcgtcgagcagcccgaagcgctggccatcggcctcgcgggccatgaccgctgcttcgagcgggatcagctcgtcctgcacgaaacgtgcgacgaggtcgcggatcatccggtgttcgagttcaaggtcgaaattcatgggagtcgatgagggtgagtaaagggaggtcgatgcagtcagccggcgttcgtgcgcgacaccgcgcgggtgcgtagcgtgccgagcaaggcgacggcgccggccgcgagcagcgcggcgttgaaatagaggccgccgcgcatcgacccggtggccgtgttgagcacgcccatcaggaacgggctcgcgaacccgccgatcgcgccggacatcgtgatcgccgcgatcgcgaccgccatcgagcgcttcggcagcgcgagccccggcagcacccagaacgcgggcagggccgcagcatgcgtggcgaccgcgacgcagagcgcgatcatcaggtgtgatgtgccggcggtgctcgccagcccggcgagcgcggccgcgcacgcgagcatcgcgactgcgccgtgcccgcgccattcgcgccgccgctcggtgcgccagcccatcgcgagcatgccgacgatgccgcacaggtagggcagcgcggacagcaccccgatccgcatcgcgccatgcaggccgccgcgatgcaggatcacgggcatcagaacacgagcgcgtagccggcggccgcgatcgcgaaattggccgcgcacagcagccagaaatcgcggtgggcaagcagcggccgtgccgcgttcgcgtccggcgtggcggcttcggcgtgcacgtgcgcggcgcgcagcgcggccttgtcggcgtccgacagccagcgcgcgtcgtccggccggtcgtcgagaaagcgcagcgcgacgaggccgagcacgctgctcggcagcccttcgactaggaacagccactgccagccgctcaggccggcggcgccatcgaagaacgagaggatggcgcccgacacggggccggcgatcagcccggcgaggtacagcgcggtcatgaacagcgcgaacgccttcgcgcgctgccgcggcggataccacgcgccgagatagaacaggatgccggggaagaagccggcctcgaacacgccgagcaggaagcggcacgcgtagaactgcgcgggcgtcgtgacgaacatcgtcgcggccgagccgagccccacagcaccatgatccgggcaatcgtcttgcgtgcgccgatccgcgccagcagcgcgttgctcggaatctcgaacgccatgtagccgatgaagaagatgcccgcgccgagcccgtagacggcgtcggagaagtgcagttcggcggccatctgcgcgtgcgcgaaaccgatgttgatccggtcgatgaacgacagcgtgtagcagaggatcaggaacggcagtagccggcgcgagatccggcggtagagcgcctgcgtcgcgcgatcgccggcggcggccgcgtgagtggaaagggtcggggtcatggacactccgtcagaagcggtgggcgatgccgagcgcgaacacctgcccggtgccgcccggttgcggctgcaggccgacgacgaccgtgttgcgggcgccgccgccgttcttcacgtacagatagcgggcgtagagcgacgtgcgcttcgacagcggatggtcgtagccgatgccgagcgcggtcgcgtcgttcgccgagcctttcacgtcgcgacgcacgaccgagacgagcacgcgatcgagcgcgccgacgttgatcgacgcgccggcgctcgcggtcgagaacgccggcaggtgcgccgccgtgccgacgccatacaggaacgcggcgtacagcttgacgcgcgcgaatgcgtagttggccgcgaacacgtagtggcgcgtcgtcgacggcgagacgacgggcgccaggttgccggccgacgtgtcgccctggaagccggcgccgagatagagcccgccgatccggtactggagcccggcgccgtagttgcgcccggcctgcgtggacagcgcgttgggcgtcggaaagccgtacgtggccatcacgcgcaggccgttccagtcggggctcaggtacgacgccgcctggttgaagcgcggaatcggcggcgtcgtgttgctcgtgatcgtgtccgtcgacgtcgcgagcagcgcgagcggcgacagccgttcgttgagcccgaacggatcgccgtcgtacacgacgtagaacgcgggcgtgtattggcggccgagccgaaggtcgccgtagcgcgtgttctgcagcgacacgtaggcctgccggtagaacagcgtgccgccctggaacgatccgtcggccggcgagaagccgctttccagcacgaacttcgtcgacgtgccgccgccgagatcctcgacgcccgtcagtccgatgcggctcgtcgacgatccgccgccgctttgccgcaggctcgacaggctgccgatgcggtcgaattcgacgtagctgtcgacgatcccgtacagcgtgaccgacgatgcgtgcgccgacgtggcgctcagcacgcacgcgccgatcaggaatgctttccgttgcatgaaggtgtctccgttccatgtcttgttgtggcgcgcccgcgttctgtgagcggttgcgcgcggggtgccgccgtgccgcgtcggttcagcgccccttgaataccggcttgcgtttctcgagaaacgcgcgggcgccctcgatccggtcctcgctcgcgtagacgtcggggccgacgtccagccgcagcgcggcggccgccggcagcccctggctgcgtgtcgcggtttccttgatgcggcggatcgtgagcggcgcgttcgcggcgatcgtccgcgccagttcgcgcacggtgtcgtcgagcgcggcggcggggacgacgcggttcagcaagccgacgcgctgcgcctcgtccgcgtcgaggcgacggcccgtgaacagcagctccatcgcgatcgcgcgcggcagcaggcgcggcagcagcacgctcgcgaagttcgcgcccatcccgacgcgcgcctcgggcagcgcgaaggtcgcgtgatcggcggcgatccgcaggtcgcacgcgagcgcgatttcaaagccgccgccgacggcgaagccgttgatggccgcgatggtcggcttgcgcagttccaggatcagctcgtgcacgttgcgggcgagcccgcgcatcggccgcatcccgcgaatctcgggatcgccgagatcgacgcccgcgctgaatgcgcgctcgcccgcgccgcggatcacgatgacgcggatcgacgggttgtcgtcgagcgtgaccagttcgtcgcacaggcgccggatcgcgtcggcggacagcgcgttggcgacgtgcgggcgatggatcgtcagccacgcgatgccgtcgtcgtcgttgcgcaggatcgacggggcgtcgtcgcccgtcagcgaggaaaatgcgcccggcgtggtcatgacgcgctcccggcagcattcgcgcgcgtgtcgtggagcacgcccgcctgccgcaacgcatcccggcgcgccgcgtcgataccgaacgcgtcgagcacggcgtcggtgtcggcggcgaacggctgcggcggccggcgtatcgatccgggcgtacgggaaagcttggcggggatgcccgcgccggtgtacgtgtcggtgtcgacgaacatcgcgttgcgagcggtttgcggatggccgaacgcgtcggcgacggtgttcaccggccccgtcgcgacgcccgcgtgcatcagccgctcgacgacctcgtcggcgcacagctcggcggtcagctggccgagcagcgtgtcgagcgcatcgcgatgcgcgacgcgctgcgcgttggtcgcgaagcgcggatcgcgcgccagctcaggcacgccgagcgcttcgacgagccgcgcaaacgtgcggttgttgccggcgccggtcgcgaccggcttgtccttgcacggatagacgccgtacggcgcgatcgcgccgtacacgttgccggtcgcgacgggaacctcgccggtcgccatccagctcgtgctgaccggatgcagcatcgacagcgccgtgctgaacaggtcgatgtcgacgtgctggccgaggccggagcgcgtccgttcgaccagcgcaagcaggacgctcgatacggcgctcatgccggccgcgaagtcgacgaccggaaacggcaccttgagcggcatgccgcccggctcgccgttgatcgacatgaagccggcgaggccctgcgcgacggcgtcgtagcccggaaaccgcgcgagcgggccgtcggtgccgtatccggagatcgagcagtggacgaggcgcggaaagcgctcgcgcaggcagtcttcgtagccgatgccccagcgttcgagcgtgccctgcttgaagttgtcgaccagcacatcggctttctcgagcaggcggaacagcacgtcgcgtccgtcgggatgcgacaggtcgagcgcgagattgagcttgttgcggttgagccccagtagtagctggagaggccgttcggcatcgcgggccccagtcgcgcgtttcgtcgccctgcggcggttcgatcttgatgacgtccgcgccgtggtcggcgagcgtctgcgcgcagaacggccccgcatagacgcggctcaggtccaccacacgcacgcccgcgagcgcgccttcgttactgctggtcatgacgatgtctccttcgatggggatgcgatgcgccggcagaccggcacgcgccggctgcacggccgtgatgcgtcggggttcagccgcgtgcggcgaagagtgcgtcgaccgccgcacgatgttccgggtcgcgtgcgcgaacgcctggtacgacgccgacaggtcgagcaccgtgtcgaggcttgcatggcggctttcgcgcagcaggcgcttggtcaggcgcaacgcggtgcccgagtggcgggcgatgcggccggccagttcgtgggcgtgcgcgaggaggtcaccgtcgggcacgacgcgcgacacgagcccgcagcgcagcgcggcctgcgcatccagtgcatcgcccgtgaacgacatttccgcggcgacggcggcgccgacgatctgcggcaggaaccatgcgccgccgtcgccgggcacgaggccgagggcgatgaagctctcggcgaagcgcgcgccgtcggcggcgatgcggatgtcgcacatgcatgcgaggtcggtgccggcgccgatcgccgggccgttgaccgccgcgatggccggcacctcgagttgctggaacgcccgtgcaaggcgctgaatgccgcggcggtagccggaccggatcgcggcaaggtcgtgcgactccgattccatgaatgcgcgcatcgccttcacgttgccgcccgacgagaacgtcgtgccggcgccggtcaggatcagcacgcggatcgactcgtcgcggttcgcgtcgtcgcagcattcggtcagcgcgtcgatcgcatcggtatccgaaatggcgttgcgggtttcgggacggttcatcgtgacggtcaggatcgggccctgccgttcacggatcagaaaggctgccatggtgtctccgtgtgttctgtgccgcggggcttcacgccgcgggccgaagcctagtatcgtcacgacggttggcggcgggaaattccgttccacatatgtggaaggcccgtcccggttgcagcggagagggcgggatgagcggaaacgtggtcaagagcgcggcgcgcgtgttcgaggtgctggaactcttcagcgcattgcagcggccgctgagcgtgcgcgagatcgccacgcgttgcgggtatccggggtcgagcgcggcggcgctgctgaccagcatgaaggcgctcggctatctttcgtacgacgacgcaacccacgcgtatgcgccgaccgcacggctcgtcaaccttggcgaagcgctcgtcgattccgcggccggcagccggcggcactggcatgccgtcgcgaaacggctggcgctgcgcacgcacgaggcggtcgtgatcgcggtgcagagcgacctgtacgtgcagtacatcgacgcggtcgagggctcgcatacgattccgatccagttctacgcgccgatcggcacgcgtcgcgagatctgcatgtcggggctcggctgggcgctgctgagccttcagccggacagcacgatccgccggctcgtatcgcgcagcattcgccggatcgggaaatcgggcaggacgatcgacgaggaggtcgtgctcgacaaggtcgaacagacgcgccggctcggttattcctattcggcgcatacggtcacgcagggcgccgcgatgatctcgatggtgatcgcggacggctggaacggcctgccgctggccatgggcgtggccgggcccgtcgagcggatcggcgcgcgtcgcgacgcgatcgtgcgggcgatgcgcgaggcgctggacgcgcagcgtacggatgcggcgtccggctagccggccgaggccggcgcacgcaggcattcgcatagaatcgggcggtttcgccgctcttgtcccgactgcatttcagcgaggctgtcatgtcattgaacgcgccgctttccggcatccacatcatcgaattcgaaggtctcggccccggcccgctcgcgggctggatgctcgcggggatgggcgcgcggatcacgctgatcgcgcgcccggccggccgcacgagcgcgccggacgcattgaaggcccgcgacggcgacctgctgcgcgaaggcaagacgatcgtcgaactcgacctgaagtcgccggccggccgcgaggccgcgctcgacctgatcgcgcaggccgatgcgctgatcgagggcctgcggcccggcgtgatggagcggctcggcctcgggcctgaagattgcgcgcgccgcaatccgaagctcgtgtacggccggatgaccggctggggccagcacggcccgctcgcggccgcggccgggcacgacctgaactacgtcgcgctgacagggctgctgtcgctgtccgcgccgcgcgacggccggccggggttgccgccgaccgtcgtcggcgatgcgggcggcgcgctcgggctcgcgttcgggatcgtctgcgcgctgttcgacgtgcgcggcggcgggccggggcgggtggtcgacggcgcgatcgtcgacatcgtgtcgatgctcggttcgctcgcgctgtgggcgcgcgcgaacgggcagctcgacggcgcgcagccgagcctgttccacgatgcgccgttctacgacgtgtatcgctgcgcggacggcgagtgcgtgacgatcggcgcgctcgagccccgttctacgcgctgctggtcgaacggctcgggctgaccgacgtcgatccggcgtcgcagtacgaccgcgcacgctggcccgcgctgaaggcgcgtttcgccgacgtgttcgcgcagcagccgtccgcgtactggcgcgcgctgctcgaaggcaccgacgtgtgcttcgcgccgctgctgagcgtggcggacgcggtcgcgcatccgcataacgtcgcacgcgggatctatcgaacggacgagaacggcaacgtgcgggcgcgggtggcgccgcggtttttgccgctggcggggatgaggccgagtagcgcgtcgaagctcgcggtgagggagcaaacccggcgttatcgtgagggcattctggatagagccaaagttggtaccgaacaaggtgcggtgaaatctcgatcgaatcaggagcggacatgtcccacaccattctggccagcgtgacggcgagcgtttcggagctgaagcggagcccgacgggaaccgtggcggtgggcgagggcttcccggtcgcgatcctgaaccacaacgaaccggcgttctactgcatcccggcgaagacatgggaggcgatggtcgaacgtctcgaggatatcgaagacaacgcgctcgtcgattcgcgcgccaacgggaaagtcgtcaaggtcaaactggttgacctttgagttcgccttgctcgaacctgcgttgaaggcgtggaagaagctcgatcgaaccgttcgcgatcggttcgaggcgagacttgccgaacggctcgaaaatcctcgcattccttcggccaggccgtgcgacacgcgctgtggcttcggcgtttcgcggcttgtctcgtcgaaccggccggtgccgcccgtcaggccgtctcttccggcgcatccggcatcttcccgtcgccgacgcggttgatcgtgccttgcgcgatcgcgacgagccgttcgtgatcgccgtcgatgacgaacacgtgacactggcaggtcgcctgatgccggcccgcgtacacgagcttcgcgcgcgcgacgagcgtgccgttcacggccggccgcaggtagttgatcttgtattcggccgtaatcacgcgcgggcccagcacgagcgcgccggcgaacgtcagcgcgttgtccgccaggtagctgatgacgccgccgtgcacgaacccgtgttgctgccgcagttcctcgcgcacgggcaggcacagcgacacttcgttgtcgccgatatgcatcagctccgtgcccagcagcatgctgaacggttgcgcgcgcaatgcgccgcgcgcgtgatccgtgatgtcggtcatcgaacttccttcgaaatgagcgcccgcttgcgctgaactctaggaagggggctgcggataagcaaggaaattcgtccgcatttcgtgcaaattccggcgcgatgcgacgcgattattgcgtcgaataccgaagatccccggtttgccggcgattccgcgggaatgcaggagcaacgtgaactttgccgtctcccggtcctaaagtccgacgaagaaatgccgctaatgccggggcattgcctcatcgtccgctttccaggaatctccccatgttcggaaaaatcaagctcgcgtcgggtctgctcggcgtgttgaccgtgttctgccttttcctgttcgcgatcgaggcgctcggcttctgggcgctcacgtcgacgcgcagcggcgtcgacgacctgtcgaacgtcgcgatcacgcaggtcggcgcggcgagccaggccacccagcaactgctcgacgcgcgcatcaacctgtcgcgcgccggcacgcggatggtgcgcggcggcccgaagccggacgacatcatccgccatgccggcgcgtcgctcgcggaagccgacaaggcgttcgccgcgctgacggccgtgcagccggtcgacgagatcaaccgcgcgcgcgtcgcggcgctcaccgagcgctatcgcgctgcgcggcgcgctgggcgaactcgtgcagttcctcgacgccggcaacatccaggcattcctcgaccagccgacgcagggcatccaggacgcctatatcgccgagctgcgccgcttcaccgactacggcggcacatcgagccgctcggcgctcgatacgatcgacggcggcatgctgtggttcaagtcggtcggcatcgtgctgctggtagcgatgctcgtggcgagcgcggcgatctacgcggccgcgcggcgcgcggtcgtcgcgccgctggaagaagccggccgccatttcgagcggatcgcgcagggccggctcgatgaagtcgtgcgggcaggcggcgtgttcgagatcgaccggatgctgcgcggcctcgcgacgatgcagacgagcatcgcgggcaccgtgcgcacggtgcgccaggcgtccgatgcgatccacctcggcgcgggcgagatcgcgggcggcaacgccgacctgtcggcgcgcacgggcacccaggccgcatcgctcgaggaaacggccgcgagcatggaggagctgacggcaaccgtccgtcagaacaccgacagcgcccgcgcggcgagcgcgctggccgacgcggcgctcgaggcgacgagccacggcggcggcgtggtcgacagcgtgatcgaccggatgcgcggcatcgcgcagagctcggggcggatcgcggagatcatctcggtgatcgacggcatcgcgttccagaccaacatcctggcgctgaacgcggccgtcgaggccgcgcgggccggcgaacagggccgcggctttgcggtcgtcgcgggcgaagtgcgctcgctcgcgcagcgcagcgcgcaatcggcgaaggagatcaaggcgctgatcgaggattcggtcgcgcagatcaacggcggcgcggaactcgtcgagcgcgccggcgaagcgatgcggacggtgtcgacgtcgatcacgcgcgtcgtgcagacgatgtccgagatcacctcggcgtcggtcgagcagagcgtcgggatcgagcaggtgaaccaggccgtcacgcagatggatcagctcacgcagcagaacgcggcgctggtcgaggaagtcgcggcggcggccgcgtcgctgaacgaccagacctcgcacctgatgcaggccgtgtcggtattcgaactgggcgacggccgtgccgcacgcgacgaacgcgcggcgccgtcgttcgccgggacgggttacgaaccggctggcagcgccgcgtaggcggtcgcgaggtggtagggcgtcgtcgacggcatgtcggcgcgcgacacctgcccgtcagccgtcttgcactcgaaccagccgcgcggatgcaggaagcgcgcggcgaagcgctcgatctgccgcgcgagcgcgcggaggccggcgtgccgccgtgcgtcgcgagcgcacgcaggtactccgtctgcgcccagatccgctgcgtgccgtcgacgcacgcgccttgcgcatcgagcgccgcgcagacgccgcccgtctgcggatcgacaccgtattgctccgcaaagccgaacgcgcgcgacagtgcagcggggagccccgtttgcgcgagccgcgcgccggccgcatcgaccaggtagaaccactcgaactgatgaccgggctcgaaacggttgtctgccgcgccgagcggcagctcggccacgcagccggtcgccgcgtcgacgaacgtgcgctcgacggcctgcgcggtgtgcgcgagcgcgtcgtcgaacgccgcgtcgccgaatgcatcggcagccgcgagccacgcttcggtcaggtgcatcagcggattctgcagcgccccgctgccggatgacgagaaatcggcgtggcgcgccgcatcgagcagcgcgtcgccgggatgcggcgcgaaacggtcgcggatcagcgcggcggtctcctcggccgtcgtgcgcgcggcggcgtcgcccgacgccgcataccaggcggcacacgcgaacacgatgaatgcgtgcgtatagagatccttggtcgtgtcgagcggcgcgccctgcgcgtcgacgctgtagatccagccgccgtggcgcgtgtcgcgaaagcgccggcccagcgcgtcgaacagcgtggctgcgtgcgcggtgtcgccggcctgcgcgaacacgaacagttgccgtgcgcacgccattgcgcgataacgggtcacgggcagcggcgcgtgggtggccggatcgacggcttcgaacggcagctgcaatgtctggtcgaaccctgaaccccgccagatcggcaagacgacgtgcgcgaaatggtggcgcagctgggcggcctgggcggaagcggagtcggaaacggacatgacggggttgagcgctgggttcgaaacgtgtcggcgcggcccggaggatcggcgcggccggggccaaggataaaacattccgcgcggccggcaccaaaaaggagataaatcgcatgctgagcaacctggaactcgtgatgcggctcgttctcgcggcggcgctcggcagcgtcatcggcttcgagcgcgagcgcctgtcgtgggccgccggcctgcgcacgcacatgctcgtctgtgtcggttcgacgctgatcatgatcgtgtcggcgttcggtttcgccgacgtgctcggcagcagcgaccacatcatgctcgatccgtcgcggatcgccgcgcaggtcgtgtcgggcatcggcttcctcggcgcgggttcgatcctgctgcgcggcgagatcgtgcgcgggctgacgaccgccgcgagcctgtggtcggtcgccgcgatcggccttgcggtgggcggcgggctgtacgtcgcgtcgatttcggcgacgatcatcatcctgatcatcctggccggcatcaagccgctggagcggcgctacttcacggtgcggcagcgccgtcaggtcgcgctgacggtcgtgagcggcacgctgaacttcgattcgctgcatgcggcgctcggcccggacagtgcgcgcgtgaagcagttcatcgtgcagcgtgccgacgacacgggcgagcacgacgaggtgcgcatcgcgctcgcgcgggtgtcggcgctcgaataccaggcgatctgcgacaagctgcgcgcgctgaagggcgtgacgcgttttgaagagggcaacgggctgtcgggcgacgaataggctgaatcggcaacggggcatgcgacaatggccgaccaccgattccgttcgacatccggttccgtgttcgcgggccccgctatccgatttccatgaccgaatccgtttcctcgcctcgctcccgttcccgttccaatcgttcgtcggcccgttcccgccagcgctcggctgctgccgcgggagtacgtccgcgagggcgacggcgcggtccggcagtgcgccggccgccgacgcgtcgcgggacgagcgaacgctcgacctgttcggcgatccggtgttcgagccgggcgagcgcgcgccggttgcggttcgcgacgaagcgggggcgcaggccgatgcagcggtcgatatcgcggacgatgtggcctccgggcggcagcccgcgctggacgggttcggtgcgcgggaaggggcgggcgcggcggcacatgcggaagcggcagagggcgcggtgatgccggaagtcgcgacggtggcccatggcgtttcggtgccgcaaggtgaggaggttgcagatgccgacatcgtgccggcctccggggctgttgcgatgaaggcggtcgatattcccgtggcgggtggcgttgcaacgaaatccgccgatgtgcccgcggccgacgccgtcacgatggcagcgaccaggctgcaggcggccgatgatacggcgccgaaggtggccgaagcgcaagcagctggcggcgaagttgagcaggctgttgtcgccgctgccgccgccgtcaaatcccgcgaagggcgatcttccggcgacgccgtgaaggagcgtcgtgcgtcgtcgggcggcaaacgtcgggcggctgccggtgcaagcgacgcgacagcagagcaatctgcgccagtcgtgacgagcgtcgacacggcgcgagcggcggccggggcgagtcctgcaccggacgcggtgtcgatcgtcgagccgcaggcgtcggcggagccgaccaagccggcagtcgccgcgaacccggtgaacacggcgaacacggcgaacacggcgaacacggcgaacacggcgaacacggcgaacacggcgaacacggcgaacacggcgaacacggcgaacacggcgaatattgcgaaggccgtggacgccgcgccgcaccccgacaccaccgtatcccctgccacccagccgatggcttccgctgcgtcctttgtcacgaagccgtcggtggagcgcgcgcaaccggccgcgccggtcttcgatccggatacgcacctgcgtccgctgaccgaccgcctcgccgcgctgcaggccgacgtcgacggtttgacgcgcaccgccgatcgcgagatgcgccgcgtcaaccgcctgctgctggccttggccgtcgtcgtgctggccgggctcgttgcgctggtgcttcagacgcggcagatcgcgcacctgaagcaggacgtcgccacgaagcagcagcggatcgatcgcctcgcggccgatctgtcgacgcagcaggcaacgctgatgacgctcgaggagcatcacgaggcgcttctgtcgcaagtcgaccggctccagcgcaacgcgaatcgcgaggcggccgtcgcgaaacgtgcgcaccgcacgcgctaatcgtttcgaccctatcctgggagcccgacggagcaaggatcgcggttccgcgtcggcgatcaggcgctgcgggcatgcggcaaactgatgcggtgcgctggcagagttcaggaaaacccttagaatagcgtccatctaagggaaaaccctagtcacatctgtcaggagtctcacatgagcttcatcctcgccctgctgcaaaagatcgacgacctcttcgtgtcgccccacctgccgctcgacgccgaatactcgtacgctgcgcgtcgtgccgaagccgagcgcgtgcgccgtgcgcacctcgtgccgatcgtcctgtatcgtcgctgattcgctgattcgctgattcgctgattcgctgattcgctgattcgctgattcgctgattcgcggccagcgcggccccgccgcacctgcctgcccgctttccgccgccgcatcgcgcgccggcgcgaccgtcccgctacactggaagtccgaatccgttcacggtgaccgggccatgctgcagatgcggccgatgacggccagagaattccacgcgtaccgtacgcgagccatcgacggctacgcgcgcgatctcgtttcatccggacaaaatgctgtcgaagacgcgaccagccgggcgcgcgcctgtttcgacacgctgctgccggatggcttgcggacctccggccagaccctcgtcgtgctcgtcgacaccgccagcggcgacgcggtgggcgacctctggtacgcgatcgtgcccgaagggccgaaccgcacgctgttcatctacgacctcgacatcgtcccgtcccggcgtcgccagggctgggccacacgcacgctcgatgcgctcgacgtcgaggcgcgccgctacggcatcaccgagatcgggctgtcggtgttcaatcacaacacggcggcccgcgcgctgtatcgtgcgtgcggcttcgcgccgatcacgacgacgttgatcaagccggtcattccgggctgaatcggctggcaggcgctcagctgggacttgtggccaaccgggtacgtcgcgggcggcctgcaccgtccacactcccgatccttcctgctcgccgagcgccgagcgccgagccccgagccccgagcgccgagcgccgagcgccgagcgccgagccccgagccccgagccccgagccccgagccccgagccccgagccccgagcgccgagcgccgagcgccgagccccgagccccgagccccgagcgccgagcgccgagccccgagcgccgagccccgagccccgagccccgagccccgagccccgagccccgagccccgagccccgagccccaagccccaagcaaccgaccccgaccatcaaacaccgacagccgaacggcccttcgaccattcgaccgtcctgcacgcgccgcccacacccgctcagtgcgcgcgccctttccatctccgcagcagcagcgcattggtcacgacgctgacgctggaaaacgccatcgccgcgcccgcgatcaccgggttcagccagccgagcgccgcgagcggcacgccgaccaggttgtagacgaacgcccagaacaggttctgctggatcttccggtacgtgcgtctggagatgtcgatcgcatcggcgacgagcgccgggtcgccgcgcatcagcgtgatgccggccgtatgcatcgcgacgtcggtgccggtggccatcgcgatgccgacgtcggccgcggcaagcgcgggcgcatcgttgatcccgtcgccgaccatcgcgacgattccgccgtgcgtgcgcttcagctcggcgacgacgcgcgccttgtcgtcgggcagcacctgcgcatgcacctcgccgatgccgagcgacgccgcgacggctgccgcgctgccacggttgtcgcccgtcacgagcacgctcgcgacgccgcgcgccgacagtgccgcgatcgcgtcgcgggcgcccggcttcacggtgtcgccgaaagcgatcagcgcgagcaacgcgcgcggtgcatcggcgcgcatcagccacgagatcgtgttgcccgcgcgttcgagctccgccgcgcgcgcgtcgagcgcgggcggcacggcgatgccgagctcgtcgcgccagcgtgtgctgcccagcgcgagcaactgcccgccgacgcgggcttccacgccgcgtcccgccaccgcgcgcgcatcggccgcgcttgccggcggcaccgcactgccgcgcgcggcaacgtcagcgtcgtgcgcggcgaccacggcgcgcgcgagcggatggtcgctctgacgctgcaccgccgccgcgagtgcgagcgcttcgtcatgcggcacgccgacggcttcgaacgccgtcacggacggcttgccttcggtcagcgtgccggtcttgtcgaacgcgatcacggtggtgcgctgcgcgagttcgagcgcctgcgcatccttgatcagcacgccgcgccgcgccgcgacgcctgtgccggccatgatcgcggcgggcgtcgcgaggccgagcgcacacgggcacgcgatgacgagcaccgcgaccgcgttgaggatcgcggtttcggtgccggcgccggcgatcagccagccggccagcgtcagcacggcgatgccgaggatggcgggcacgaacacctcgctcacgcgatcgacgagccgctggatcggcgccttctcggcctgcgcggattcgacgaggcggatgatgcgcgcgagcgtcgtctccgcgccgatcgcggtggtttcgacgacgagcgcgccttcgccattgatcgagccggccgtgacggggtcgccgtcgtccttcggcaccggcaggctctcgccggtgatcagcgattcgtcgatgtgcgagcgacccgacacgatccggccgtcgacgggcacgcgctcgccgggccggatgctgacgcgggtgccgacacgcacctgcgccagcggcacgtcgcgttcgacaccgtgctcgacgacgcgggcccggtcgggacgcaacgcgttcagcgcgcggatcgcgtcggtggtctggcgcttcgcgcgcgattcgagccatttgccgaagcgcaccagcgtgacgatgacggccgacgcttcgaaatacaggtggccgggatgggcggtgccgcgcagcagcatccacaggctcagcccgtatgcggccgacgtgccgagcgcgacgagcaggtccatgttgccggtgcgcgccttcaccgcgtgccaggccgcgcgatagaagcgcgcgccgaagccgaactggacgatcgaggcgagcacgagctggacccagccgttcggcatcaggtggatgccgaacggcgcgacgagcatcggcgcgatcagggcgcgctcagcaccgcagaccagatcacgagatcgcgttcgcggattgcttcgaggcgcttgcgtgtttcggggtcctgcgcggcgccggacggctgcgcgtcggcgccggccgtggcgccggctgacgacgcgtcggcgagcgacgcgcgatagccggcggtggtgacggccgcgatcagcgtggcggcgtcgagggcgccggcgccgtgcaccgacgcgcgctcggtcgcgaggttgaccgcaacgcgggcgacgcccggcacggcggccagcgcttttcgacgcggccgacgcaggacgcgcaggtcatgccgtcgatgtcgagttcgaggtcggcgggggcggtggaagcagccggcgggatggccgcgccggcaaccggcgtcgcgccgtatccggcttgtttgacggcttcagcgagccgggcggcggtaacgtcgggcgcggcgttcacggtcgcccgttcggtcgcgaggttgaccgacgcccgcgtgacgcccggcaccttcgccagtgctttctcgacgcgcgacacgcacgacgcgcaggtcatcccgtcgatgtcgagttcgatgctggcgggcgcggcaggcgaggagggcgagcgcggcgaagcctgcatccgttacggtcggtgtcgcgccgtagccggcctgtttcacggtttccaccagttgtgcggcggaaacgtcggccgtgacatcgacggtcgcccgttcggtcgcgaggttgaccgacgcgcgcgtgacgcccggcaccttcgccagcgccttctcgacgcgcgacacgcaggacgcgcaggtcatcccgtcgatatcgagttcgacggtgctggtggccgggagcgggcggccggcagtcgaagcggctgcggccatcggcgtgggcgatgcttcgacaggatgcgcctgcgtggcggcggcgacttcgagcactggtgcgcgtacggaggcgccgtagccggctgcgccgatcgcctcgatcagtcgcgcggcgtcgatggtttcctgcgcagtcaccgtcgccgcgtgcgcgtcgaggtcgaccgccgcctcgacgacgcccggcaccgcggccagcgcccgttgcacgcggcccgtgcagccgccgcaatgcatgccgtcgacgctcagctcgatcgtgtgcagcgctgtggaggcaagtgattctgtcatgtcggattccctgaatgcacggctcgtgccgcgaatggaaccagtatcaacattcccatgatggtaaggtcaagcggtggcagcgcatgccgatgcacacagggtgtcacaacgcggaaaaagcaatctcccggattcctgaccgacatccgggaggggcgggccttgcgctcgactgcgcgatcaggcgcagagcttggcgctcgcgagacgattcaggctgacgccctgctcggcggcctggatcaccagcgcgcggtgtgcctgcggcgggatgcgaaccttgaattcaccgctgtaggtgcggtcggcgatcggctcgggcaccttttctccgtttgcggtcatgtcgcgaatgacatcggcgacgagccggcgaataccggccagcgcaccttccggcgttgcgtcgagccacgaaagagacgggaattccgcgcacaggccaacgtgctccccgtcctccggggaccacgttacgcggtacgtaaagtggtcttgagtcatgatttctgttccttcagtcgatcgatcgcgtcgagaacctgtcgcacctgatcgtcgaatcgcacgttcgcaggctcgcgcctcatgagttcgaggatcttccatacgctagccgcatcgaatggtgtcattagtgacaccattcgtcaatcgaccagccggcccccgcactcgagattgtttcgccttgagcgtgtgtcgctccgatatcccctgttttgttgcaaatcgccagaactatttcgcatctgtcgacaatacggctagcgttcggccagctattcggcatattaggggatgcccgtaggcgctatgataccggcctgacatcagcgcccaccgttacgcaacgtcacgaaacggttatccgggcacgctggggtgccttgctttcgccattcgcgcgtcgcacaaggcgttgactgaaaagaacgatattcggccagtactcgatgattgaaaaccagcaggaatcagtttctctgcggcgcgtgtgcgcgtcgctggccatggcggcgttgcttgcggggtgcgcgtcgcaaccggatgccattcagcggaaaaccggctggatgcgcgcggaagtcgccgactcctatgacgcgtatccgctcgtgctgatggacgtcgcgaaggaagcggcgaccggcggcgacggcgcgcagccggggcaggcgccgctcaacacgctgcgccacgcgcaggcgctgccgcccgtcggcgcggtcaatccgccgctgccgggcgtcgacacgctcgactcgaccggctggctcgacgtcgccgccgaacccgtgatcgtcacgttgcccgacacgcgcggccgttactgggacgcgcgtgcgctcgacatgtggacgaacgtgctgtggtcgtcgtcgagcgtggctgcacgcggcacacgcggcggtgtgcgatcgcaaacgattgccttcgccgcgaaggattggcagggcacgctgccgaaggggcggtccggatcgacgtcccgtcggccaacgcgtggctcgaagtccgtctgcagacgagcggcgggcgcgacctgacgaacgtgaagaaattgcagcgcgcgatccgcgtggtgccgctgtccgtctacacggcgcggcgcgcggcgcgtcggtggcggtccatgcgggcagcgcgccgtccgaggcggtgggcggcggcacgccggccgagcaggtggccgcgctcgacccgaaggcgttcttcgcgcgcttcgcgcaggcgctgcaggacaacccggcgccggccgacgacgcacacgcgcaggcgttgctcggcgacatcggcgtgtcggccggctacccggtgctgtggacgggcgaccgcctcgcggccgcgacggccggcgtcgccgaggcgcgcgcggctcgcgaccccgccgtcgaacctgctgaacgcgaacggctggagctggatcggcgatacggccggcaagtacggccaggactacacgctgcgcgcgtacgcggcctacacgcagttcggcaccgcgacgcgcgacgacgaaacgctcgcggtcgtgcgtgtcgacagcgacggccatcagttgaacggagcgaaccgctacgtgctgcatttcgcgccgggcgcgctgccgccggttcgcgcgttctggacgctcacgccgtatgcgacgaacggcgcgctgcccgacgtcgggtcggcgcgccgctcgctcggcgatcgcgaccgcctgcgccgcaaccacgacgggtcgatcgacatcgtcgtgtcggcgtcgccaggcggcacgcatgcgggcaactggttgccggcgccgcgcgccgatttcgcactcgcgttgcgcctgtacgcaccgaagccgcaggcgagcgacgggtcgtggatgccgcccgtcgtcgtccggaaatgaacggatgaccggcggcgttgtccgaccggcgggcgcgacggcgcccgaaccccgtaccgtcacctcctgagcctatactttcgggatagcgtgcgcggccgaccggtgctccggtacggccggcatcccatcccgaggcattcaagcatggcaagcgcagacaaagaaaccgtatcctcgaccctccatgccctcggtggcgttgcacgctcgcgccgcacccggcgcatcggcctcggcctgctgatcttcctcgttttattcggactgctcgggttcttcgcggcgccgccgctgatccgccatatcgccgaacagcaactgagccagcaactcgaccgccccgccacgatccgacgcatcgcgctgaacccgtacacgctgaacctcgaagccgacggcatccatctcggcgacaagggcgggcagggcgacttcatcgacatcgcgaagctcgtcgtgcggccgtcgtggtcgtcgctgttccgcggtgcgccgatcgtcaatgaaatccgcctcgactcgccgcgcttccatatcgtccgctacgatgcgcagcgcttcaatttcaccgacctgatcgagaaattctcgacgccgtcgcccaaaccggaaagcaagccgacgcagttctcggtgtcgaacatccaggtcaacaacggccggatcgatttcgacgaccgcctgctgaacgaaaagcacgtcgtcgacaactggacgctcggcattccgtatatcgcgacgctggcgtcgaagaccgacatcttcgtcgagccgaagctgcgcgcgcgcttcgacggcagcccgattgcgattgacggcaagaccaagccgttcgcgcagtcgcgcgaatcggagatcgcgctgaaattcgacggcctcgacgtgccgaagctgatctcgtacgtgcccgcgaagctgccggtggccgtgacgagcggcctgctgagcagcgacctcaaggtcaatttcgtgatgagcggcgagacgcccgcgctgcgcgtatcgggcaccgtcgacctgaacgacgcgaaggtgacggaccgcgcgtccgcgccgctgttcgccgcgcgcggcgtgcatgtcgcggcggccagcctcgagccgctgcgcaacgcgttgcacttcgacgagatccggatcgaccagccggtggtcgacctgtcgcgcgacaagcagggcgtgctgaacgtcgagaagctcgccgcgcagccggcagccgcatcgaacgccgccgagggcaagccggcggcgccgggcgccgcggccgcttctgcggctgcggtagccgccgccagcggcgcaaaggtcgaagccgccgcgaaggcggcgccgccgctcgacctgacgatccgccatttcgcgatcgacggcggcacggtcaacgtcgacgaccgcgtgccggcaacgccgaccgcgctgtcgctcacgaagctcgccgcgacgctcgacggcttctcgatgcagggcaagacccccgcgaaatacacgctgtcgacgtcgctgtcgcgcggcggcgacgtgacggccgaaggcacgttcaatctcgcggagaagcaggccgacagcaagctgacggtcgccgccctcgcgctgccggcgctgcaaccgtacctcggcgaggccacgcgtgcgcgcgtgctcgacggcacgctcggcgccaccgtcaacgcgaaggccgactggggcaagacgccgctcgccgcgcaggtcgccgacagcacggtcagcctgaagtcgctgaagatcgcgacgcccgacgcgaaggcgcccgcgatcgtgttgcccgacgcgagcgcgaagatcgcgaaggtcgacgttgccgcgcgcaccgcggagatcgcgagcgtcgacgccagcgggctcgcgctcgacgtgcagcgcctgaaggacggcaggatcgacctcgcggcactggccgaacccgcgcaggcgtcggtgccgaagcgcacggtcgcgcgcaaggccgaggccgccgcgccgtcgtggcattaccggatcgatgcgctgaacgtgaaggattcgtccgcgaacttcaccgacctgtcgacgccgcgcccggtgaagctggcgatcaagccgctggacctgtcggtgcagaagatcagcgacgacatgagcaagccgctgcccgtgcagttgaaggcgacgctgaaccgcaagggctcgctgaacgtgacgggcgacgtgaccgcgcagccgctgaagctcggcctgaagatcaacggcaaccgcctcgacgcggccgcgttcgagccgtacttcggcagcgcgctgaacgcgacgatcgccagcgcgctgctcaacgcgcagggcaacctgacgttcgcgcaggtgaaggacgcaccgcgcgcgacctatcgcggcgacgtcgcgctcgtcgacgtgcggatgctcgacaaggcgacctccgacccgttcgcgggctggcgctcgctcgcgctgacgaacctgaaggcgaactacgacgagaagggcaccgacgtcgacgcggcgcgcgtgacgttctcgaacttctacggccgcgtgctgctcgatgcgcagggacggctgaacctgaaggacgtggtcgcgaaggagacgggcccggcgcagtcgctcacgcgcgacgcgagcaagggcgaaccggtgccgctgtcgccgggcgtgacgccgccggctgccgccgcgcagcaggcgtccgcgccggccgccgcgtcggcgacggtggtcgtgaaggccgcgcagccgccgcagaacccggtgcggatgcattttggcgagttgctgctgcagaacggccgcgtcacctacaccgacaacttcatcaagccgaactacacggcgaacctggtcgcgatcaagggcacggtcggcgcgttcggcacggattcgacgacgtccgcgccggtcgacgtcgccgcgaacctcgcgggcaacgggccgatctcgatcaagggttcggtgaacccgctgatcgagaagccggcgctcgacctcaccgcgaccgcgcacgacatcgagctgaccaacctgacgccgtattcggcgaagtacgcgggctacccgatcacgaagggcaagctcaacgtcgacctgcattacgagctcgcgaacgaccagctgaaggcgaacaaccacatcttcatcgaccagctcacgttcggcgaccatgtggagaacgacacggcaaccaagctgccggtgaagctcgcgatttcgctgctgaagaacacgcgcggccagatcgacgtgaacctgccggtgtcgggctcgctgtcgaaccccgagttcagtgtcggcgggctgatctggcgcgcggtgctgaacctgatcgcgaaggccgtcacgtcgccgttctcgctgctcgcgcatgcgttcggcagcggcggcgaggatctcggctacgtcgaattcgcgccgggctcgtaccagctcgacgacgcgcagcagaagaagctcgataccgtcgtgaagatgctgaccgagaagccgtcgatccgcctcgacctgatcggccgcgtcgacccggcaaaggacacgtcggggctcggcgacgcgtacgtcgagcggctggtgcgccagcagaagctgaaggacgtgatcgggcagggcgagagcatcgacccgatgtcggtgaaggtcgagccggccgagtacagcaagtacctgacgcgcgcgtacaaggccgccgacttcaagaagccgcgcaacctgatcggcctgcagaagacgctgcccgatgccgacatgaagaaggcgctcgccgaacacgcgccggccgacgacaacgcgctgcgtgcgctcgcacagcagcgcgcgcaggccgtgcgccagtacctcgaggggaagatcgattcgagccgcgtgttcgtcgtcgcgccgaagctcgatgcgaagggcatcgacgacaagggcgcgaccacccgcgtcgatttcggcctgcagtaagcaggccgtccgccgccgccgcgtccgttcctccgttcgggcgcggcggcgcgctgccttcagcgcgcggcgatcgccggttcctcgcgcttgcccaattccttcttcgcggccagcggcaggcgtgcatcgtcccactgcgccagccattcgacttccttcgcggtgaacacctgtccgtagttgcgcaacgcgtactgcaacgcgtcgacgacgtggtggcgaatgatttcggggtgcgtgcatcgtccagcacgaaccggagggcttccagggtcgacatactcatgctccgggtcagggaaaaccctttatcacacgccaatagtcgcgcgccaagccggaaaatcgtgcggcgggtgacgccgcggacggtggccgatgcaccggggcggtgcttgccggtgagcgcgcgagtccgcaacgtgcgcccggccacgctggtttgcgaccgcgtcgtgtcacttgcgattggttacgtttgatagaaaacagaaagccccgcttcatgcgagcgacccacgacgcagccatattcttgcgcgcctgatggcaagtcacgcagttcaacgtcaatcgatgaggtggggtgatcatgtctttccttgggaagcagcggaagtgggtggggatggtggcgggcgcgctggcgctcgcaggcgcgggcgcgcatgcggcgcagcaggacggcaaccgtcagggcgcggaccgcggccacgcgaaccgcgtcgtgaagcacgtgctgctgatcagcgtcgacggcctgcacgagcaggatctcgcgcgctgcatcggcgcgaacacgtgcccgaatatcgcggtgctcgcgaagagcggcgtgacctacacgaatgcctatacgcccggcctgtcggattcgtttccgggcctcgccgcgctcgtgaccggcggctcgccgaagacggccggcctgttctacgacgtgtcgtacgatcgcaacctgtacgcgccgggcgacacgagctgctcgggcaagcagggctggaacgtcgtgttcgacgagacgaccggcatcgacgcggagaacggcggcgcgctggttcacctgaacggcggcggcgcattcaatccgcaggcgatcccgaacgcgaaggtcgacggcaagtgcgtgccggtctatccgcacaactacgtgaagaccaacacggtgttcgaggccgtgaaggcgggcatcccgaacgcgaccaccgcgtgggccgacaagcacgcatggggctacgactggctgaacgggccgtcgggcaccggcgtcgacgatctcgcgcgcaccgagatcaactcgatcgacccggcgacgcagacggactacacggacgtctattcgcataccgcgcaattcgacaacctgcacgtgcaggcgctgatcaaccagatcaacggccgcgactcgacgggcacgaagcgcgcgccggtgccgacgctgttcggcgccgatttccagacgctgagcgtcgcgcagaaggcggtggtgacgaagggcggcggctacctggatgcgaacttcacgccgaacgggcaggtcgcgaacgcgatcacgtacgtcgacaacgcgatcggccatgtcgtcgaggcgctgaagcaggcgaacctgtattcgtcgacggccgtgatcgtcacgtcgaagcatggccagtcgccgaccgatcacacgaagctcgtgaagaacggcgacacgctgacgaagctgctcgaagcgaacaactatctcgacccgaacggcaacttcggccagaacaacacgaagacgggcaacctgaacgacggttcgggcctggtcggcacgggcttcgtgcagaccgacgacgtcggcctgatctggctgcgcgaccgcaaccagcgcacggccgtggtgcagacgctgaaggcgaacctgggctgcaacgcgccggggatctgcgcggacggcccgcaggcgtacatcctgtacggcgcggcgctcgccgagcggttcggcgatccggccaacggccgcacgccggacatcatcgtccagccgaatccgggcgtgatctacacgtcgagcacgaagaaggacgaggagcacggcggcaacgcgccggacgacagccacctcggcctgctcgtgtcgtatccgggcctgcatcgcgcgcgcacggtgaccgacacggtcggcacgaagcaggtcgcgccgacgatcctcgggctgctcggtgccgacccgcgcctgctgcatgcggtggtggccgagaataccggcgtgctgccggggctcggtatcggtcgctgagcgacgcgacgccgcaggactgcccgccgccggccgcgcggcgggcggccggtgtgtcgcgtgaagtgctgcgcgaggtgctggccgcgtctacttcgcgaacagcaccggcatcatctgcagcgcgcaatcgtgcatgcgcttgccgatcgcctgcacgtccggctcgtcccgcgccatgagcgaatcgcccgcgcgtttcatcgccgcataactgccgtgcatggccgcatacaacggaatcggcgacgtggcgccggggccgggcccttcgaaatagccggttgcggcgagttcgcccaggtagtaggtgtacagcgcaccgacgtggttagcctgcagccaccccatcagctggatacgccggtagaccgacacgaggtcgtccttcgggcgcgagccgagcgcgacgaagatctgcagccgcgcgagccagttgcccttgcgcgcggcctcgacgagcgccgtccactgcgcgggcgtcgtcgagccgggttcgcgcaggctgctcatgtagtcgatcacggcctgctggtccggagccgggccgatctggtcgggcgacctgcacacgaagcgggacacgtcgatgtcggcatcgccgagattgtcgagctcgtgcttgatcttgccgtacacgtcgtcgagctgtttctgaacgtcgtccctcgaccattcggcaggcagcgggcccagccacacgagttcgtcgtcgttggccgccgcggccgcgcggtaacgggcgagcgcggcatcgcggcgccgggcggccgcggcctgctcgtcgcgcgtgtcgtcggccatgcgctgcgcgaccaggttgacggcgtcggtcagtttcgcgcagcgggcgaaggcggcgtcgcggcgcgcccagcacgcgttgtcgaccgtgtagatccagcgggtgttgacggtctccagcacatagtgcgtctcgcccgcctgccgtgcgacggcggcatgcccttgtcatcggtcacgcctcgggacagcaccttgccgtcgtgcgtggtccagctgtagggctcgctgctcagcggtatttcgctgccgctgtcgccggtcaggttgatcgcgtagtgcgtcgtcggcttcgtttcggcgtgcgcgacgccgacgacggtgagcgcggcgagcgcggcgagcgcgacagccgcgcagcggtgccgggccttcttcggggcgtgatggcgggcggctcgtggccgtggtgtgacgacggggtgttcattgccctctttctccgttgttgttctcgtcgtgcttcgttcgacgacgcgcgagtgtagcaggcgggtatcgcgacgaacggcttgaattctgtcgcccgtaccggcatattcgccacgcatcacccgttcaacgacgcaccgagaggtttgttcatgcgccttctgcttgccctgctgctgccgtggttccagttcttcacgatcggccgcccgatcgccgggatcatctgcctgatcctgcaaatcacgatcatcggctggctgccggccgcgatctggtcggtgtatgcgctgagccagtacaagaccgatcgcaagatcgaagcggagctgcgcgggcaaaagtaagcgcccgggcgattccccgtataccgggcttcgtcgatccggcagcggaagcggcgagttccgtgcgcgtcgtcggctatcccggcggcgcccttccagcgcctccgcccgcgcgaacagccagtcgacgaacgtgcgcagcgacgcatcgccgtcgtcgcgatacaggcagtgaaacggcggcccttccaggtggacttccggaaacagcgcgacgagccgcccgtgctcgagatcgtcgcgcacgaccgcacgcggcgcgaggcacacgccgagcccgctcgcggcagccttggtcatcaggaagaactcgcgatagaacggcccgcgcagcgtctcggtgacgaccgagcccgcctggtggaaccagtattgccatgcctgcggcaagcccgcgtaatgcagcagcggcgcgttgcgcaggtcggccggcgtgcgcgcgtcatcgagcaccgggtggccgggcgcgcacaccggcaccgccacggtcgcgagcagcggccgcgacacgaacccttgcggcgcagctccggcgtatagcggcggatgacgatgtcgcaggtttcgtcgaactggtcgcgttcggtgtcgggcgtcgtgacgagttgcacgtcgatatccggatgcccggcctggaacgcggccagttgcgtgagcaaccatccatgcgcgaacgacaccgacgtgttgatccgcaccggatggccgccgaccggttcgagcatctggctcgtggcctgcgcgagccggccgaggcagctcgcgacgtcgacgaggtaatgccgcgcgcgcggcgtgagccgcaacgagcgcccgtcgcgttcgaacagcttctgcccgaagaacgattcaagcacgcggatctgctgcgcgaccgcgctctgggtcacgttcagctcgtcggcggcgagggtgaggctctgcaggcggccggcagcttcgaagctgcgcagcgcattcaggggcggcaatcggcgcatcgtgagatcgcgaagaaaagctacacagtgggtcaaaaatgtcgtttgtggcggccggggcgcctccctatcatggcgccgacaggagagaacgccccgatgacgatcatatcgccacccgacgcccggacaaccggatttcgccaccgtctacgcgtcctgcgcgcggcacgtcgtgcgacgaaccgcccggccgcggtgccgcccgtgcgcggccgcggcgcgctggcgctcgcctgtgccggactgttcgcggcgttgaccggatgcgcgacgaaagccgacaacgagcggcagatcggcaacggcggatcgctggtgcgctacagctcgagccagaccgaagtcgatctgaccgatgccgagcagcagacgctgcgcatgctcagcgaccgccgctatgcggacgcgacgcaggcgcgcgcactcgacgcggtggccggcagctgcgcgcgcagggttatgcgccggtgacggtcgatcgcgattcggggctggtggaagcggggcgcagcgacacgctgatcccgaagtggcgtcgctgctgcgcggcgcgctgaaggcgcgcatcgggatgctgccgacgaagcccgatcatgaacgcgtggccgcgatcgtgacggttcgggcggggcaggacgcgcacgtcgcgatcgtgcgggcgcgattcgatcgtacggtgtgggacagcgccggcgattcgcgtaccaagaccgtcatggagcccgagtactaccaggcgttcttcgcggaagtggacaaggcgatgtgcgcgacgaagtgcgagcggtgagcgggtgcgcgccggcgcgtgaaagcgtgaatgccgggaggaggatcgccacggcggcgtgccggcggcgacggtggcgcgccggaggcggattgcgcggaacgggcccggcatgcgccccggcgtgcaacgcggaaggggcctacttcacggcaaacagcgtcaggttcatgaagatcttgaacgcgtaaccgagcgtgacggcgccgattacgccgccggcccacaggacgacgaaccacatccagccgcgcatccgcggccgggggccgcggcggcggagtgttcggcggaatcagtggtggtagtaatgctggtcttcatggcgcaccttgcctcggaatacccagtaacccatcgtcgtgtaggcgatgatgatcgggaggataaccgctgcgccgaccagtgtgaaggtctggctggagcgcggcgccgcggcttcccagatcgtcatcgtctgaggaatcgcatacgggaacagcgtgacgagcaggccgacgtagccgagcagcacgagcgccagcgcgagcacgaacggcgtcatgtcatgccggttgcgcaccgcgcggcgcatccataccgcgcacgccgcgaccaggaacggcaccggcagcaggcgccagaacagccccgaatcgaaccagcgctgcgcgatggccgggtcctgcagcggcgtccacaggctgacgaccgcgatgaagccgagcagcacgagcgtcagcggccacacgacgcgatggaggcgccgctgcaggtcgccttccgtcttcgcgacgagccagcagcagccgagcagcgcgtaggtcacgatcaggccgaggccggtcagcaggctgaacggcgtgagccagtcgaaggcatcgcccgcgaacacgccgtccttcacgttgatgccctgcaggaacgcgccgagcgcgatcccctggaacagcgtcgcgccggccgagccgccgatgaacgccagatcccacagctgctgcgtgcgccgcgccttcgcgcggatctcgaacgacacgccgcggaagatcaggcacaccagcatgaagatcagcggcaggtacagcgccgacagcacggtcgaatagacgaccgggaacaccgcgaacagcccggcgccgccgagcacgagccacgtctcgttgccgtcccacacgggcgcgaccgtgttcatcatcaggtcgcgttccttctcgtccggaaagaacgggaagacgatgccgatgccgaggtcgaagccgtcgagcacgacgtacatgaagagccccaatgcgatgatcgcggcccagattacggtgacgtccataggttttctcgtatgcggaatggggtgggctcagacggtctcgatcagctcgtcgacggccgacatcgggcggcgcgcggtgtgatcggggcgcgtgtcggtgtgtcgtcgtgcttcacgtcgggcagcgcggggccggccttcatcagcttcagcatgtagtacacgccggtgccgaacacgaggaagtacacgatcacgaacgtcatcatcgacaggctgacctgctgcaccgacagcggcgacaccgcatgcgcggtgcgcatcacgccatacacgacccacggctggcggcccgcttcggtcgtgacccagcccgcgagcagcgacacgaagccggtcgggcccatcacgagcgcgaagcgctggaaccacttcgattcatacaggctgccgcggcggcgcaggaaccacgcgagcgcggcgaggccgatcatcgcgatgccgaggccgaccatgatccggaagctccagaacacgaccgtcgagttcgggcggtcttccggcgggaattccttcagcccgcggatctcgccgtcccagctgtgcgtgaggatcaggctgccgaggtgcggcaccttcaccgcgtagcgggtcgtttccgccttcatgtccgggatgccgaacaggttgagcgcggtgccgcccttctcggtttcccacagcccttcgatcgcggcgatcttcgcgggctggtgcttcagcgtgttgatgccgtgctggtcgccgatcacggcctgcagcggcgcgagcacgagcagcagccacagcgccatcgagaacatcttcttcacgcccttgtcgcggcggcccttcagcaggtgccatgcgcccgtcgcggccaccaccagcgcggcgacgatgaacgcggcgatcgccatgtggaacaggcggtacgggaacgacgggttgaagatgatcgcgaaccagtcggtcggcacgacgcggccgtcgacgatctcgaagccctgcggcgtctgcatccagctgttcgacgcgagaatccagaacgtcgagatcagcgtgccgatcgcgaccatcagcgtcgcgccgaagtgcgcgcgggggctcacgcggttccagccgaacagcatgatgccgaggaagccggcctcgaggaagaacgcggtcatgacctcgtacatcagcagcggcccggtgacggcgccggcgaagctcgagaagcccgaccagttcgtgccgaactggtagctcatcacgacgccggaaacgacgcccatcccgaacgcgaccgcgaagatcttcgaccagaacaggcagagggttttgtagtactgcttgccggttttcagccagcgatattcgaggacggcgatgaagctggcgaggccgatgctcagcgccggaaagacgatgtgaaaggagacggtgaacgcgaattgcaggcgggccagatcgagggccgaaagagcggtgtccataccagttgaccgaggctgacgatacccgccggcgggtgccggcggaccccggcggacgggcgtcggggttggctggagtatgggccgcgatgttgcaccgcgaaatgcgccaactcgtcgcagatgtccagcccggcgcgcgcgattccggggtaaatcgttgattcgtatcaagaaggctgcttgcggcgcgcgcggccgcggcgtggcggtctgacgcacgtgcgtcaatatggcgcgtcgcgtcatcggaacggttcgatccgggcgcgaacgctgcgcgacaccgcacctcggcgcccgcgcgcggccgaaccgttgcggtgcgttatcgcgtaacgcacccgcccgtgccggcgggccgcgggtgatggggtctgtcacatcggtaacgccgcgcaacattggcgcgtgcgcccgtaatggatgacggatcgcgcgcggcgtagcgttcggtatgtcgggttcgcatcgacgaaccgccagccggagaacgtgacgtgaatggattgaagctcgcactgggcgcggtggccgcagtggcgatcgcgacgggtggtgtggcgcatgccgcccgggtcggggtctatgtcggccccggctacccgtattactaccccgtcgtccctgcgccttattactacccgccgcccgtcgtcgcggtacccgtcgccccggggccgccgcccgagtacgtcgagaaagggcagccgcaggacgacggcgacgcgaacgtctggtactactgcgacgcgtcgaagcattactacccgcatgtgaagacctgcaagtcgggctggcgatcggtgccggcacggcctcagtgacggaggcgcgacgatgaaatccctgtttcgaccactgcgcgtgccggccgcgctggcgctggccggcctgctcggcgcgtgcgcgtacatgccgaccgggccgagcgtgatggcgctgcccggcaccggcaagtcgttcgaccagttccgtgccgacgatgcgaactgccgtcaatacgcgttcgagcaatcgggcggcgtgagtgccgggcaggcatcgaccgcgagcgcggtcggcagcgcggccgtcggcaccgcgctcggggcggcggccggcgcggcgttcaacggcggcacgggtgcggccgtcggcgcaggcgcggggctgctcgcgggcagcgtggtcggcgccggtgcggcgcaaggctcggcctacgacatccagcgccgctacgactacggctacctgcaatgcatgtacgcgaccggcaaccgcgtgccggtgccgggcgggatgagcggcggcggtgggggcggtggatacggcggtggcggatacggcggcgcaccgcgcgcggcaccgccgatgccgccggcgggtgtccagccgccgccgccgcgctactgacggcggcccgggcggcggcgtgccgcatcgcgtgccggtgcgccgtgctcgcgtcgaccgtcggccgtcggcacacacgctgcgtgaattgcgtacactctgagtctcgtttcggcagggccgggcgcatcggttccggtccgcgtttacccaggactcagcgatgatcgatttacgcagcgataccgtgacacgtccgagccaggcaatgctggccgcgatgactgccgccgaagtcggcgacgacgtatggggtgacgacccgaccgtgctgcgcctgcaggcggtgatggccgagcgggccggcaaggaagccggcctgttcttcccgagcggcacgcagagcaacctcgccgcgctgatggcccattgcgaacgcggcgacgagtacatcgtcggccagctcgcgcacacctacaagtacgaaggcggcggtgcggccgtgctgggcagcatccagccgcagccgatcgagaacgcgccggacggcacgctgccgctcgcgaagatcgccgcggcgatcaagccgatcgacaatcactttgcccgcacgcgcctgctcgcgctcgaaaacacgatcggcggccaggtcttgccggaaggctatgtccaggaagccaccgcgttcgcgcgcagccgcgggttggcgctgcatctcgacggcgcgcgcgtgcaacgccgccgtcgcgtcgggccgttcgatcgccgagtgtgcgcgccgttcgacaccgtgtcgatctgcttttcgaaagggctcggcgcaccggtcggctcggtgctggtcggcaaccgcgtgctgatcgagcgcgcgcagcgctggcgcaaggtgctcggcggcgcgatgcggcagtcgggcattctcgcggccgcgtgcctgtatgcgctcgaccacaacgtcgagcggctcgcggacgatcacgcgaacgccgcgcatctcgcggcaggcctcgcgcgcatcgacgcggtgaaggtgctgtcgcacgcgacgaacatggtgttcgcgcaattcccgaagccgattgcgcgccgctcgaggcgtggctcaaggaacgcgggatcctcacgcagatgctgtacgcgtcgcgcttcgtcacgcactgcgacgtgtcgcgcgcggacatcgataccttcatcggtgcggtcggcgcgtatttcgcgcagcgccgcgcgtaacggggaatgcgccggccggcgggagagccggcacgaggtggcgcgaagcagggagcgaagaggcgacggggcgacggggcaacccgtctgtcgatatcgggcgagccggcggattacgcttgccggggtgcgtcggcgggggcgtgccgtcgcggaacagcgctttcagttgcgtgcgcagttcggcgctgtcggtgtgctggtgcaccagcaccgcgtgttgcacggcggcctccagcagttcgttgtcggagtcggcggaaatcgcgaccgagcaatgcgtcgcgctgggaaactcgcggcaatcgatatagcggcgggacatgatgttctccttgcgggaaagggaacggccggatgtgcgtgatcggccgcgcggcgcgttcgcgaggccgatggaaaaagtataggcggcgcggcagggtttctcgccgcaatgcgtaccgcgccgcgcgccatgcaccgccctggcggtgtcgatcacccgcgcgtcacggcagcggcgcgagcagccggcgcgccgcctcgacgacgcgttccgacaacgacgccatcgtcggcgactgcacggtccacgcgtgccagtacagcgtgacgtcggtcggatgcgcgggcgcgagatcgacgagcccctgcgcgtcgagcggcgcggcgccgatcagggctccggcaccatcgcatagccgagcccgtgccgcaccgccgcgaagtgcgaatgggtgcccggcacgtagtggcacgggtaggcgccctcgggcagcccgaacttctccttcaggaacgacgactgcagcgtatcgcgccgcgagtacgcgacgacgggcgccttgcgcgcgctcgtgcggttcagcccgcgcgggaaccagcgcaccgcgaacgcggcggccgcgagcagccggtagcgcatcgtgccgagcggcgtcgcgaggcagccgcgcatcggcttcggctcggtcgtcacgcagcccaccgccatcccgctttcgagcagcgcgaacgtgtggtcctggtcttcgacgatcagctcgaacaggatgcgctcgccggcgagtacggacgtcagtgccgggagaaaccacgtgccgaggctgtcggaattgagcgcgatcgtgaccgagatcggcgattcgcgctcggtcgcgagcgtgctttgcaggtcggcctgcagcagcgcgacgcggcgaaggtgcagcacgcgctgcccggccaccgtcgggcggcacggccgcgtgcgcagcacgagcggcgtgccgaggcttgcttccagtgcgcggacccgctgcgtgacggccgatgcggtcacgtgcaggcgcacggccgcctgctcgaagctgcccgtgtcggcgacggccagcagtgcggcggcctgcttaggatcgatcgtcatcgacatgtcggtggcattcctgtgaacgtaagacgagaggagccgctagtgtaaggcagcccgcccgcgcgcccggttgcggcgcatcgtgctgccgtgccgcattggtcgtcgggaatcggccgagacatcgcgcacaccgcatcccggtggtgcgcgcattttgaactaggctatatgaacgcgcggaacccgggcatgtgccatgcctgcactccgcgcgcggacgatcgcgcgtcgcgcgcaagccgcggcgcgggcgtcgtgacgattcccatttgacggagacgaacatgtcgattcgactaggcgaggacgcgcccgatttcaccgcggagaccaccgagggaacgatccgctttcatgaatggatcggcgaccattgggcgatcctgttttcccatccgaaggatttcacgccggtatgcacgaccgaactcggctacatggccgggctcaagccggaattcgacaagcgcaacacgaagatcatcgggctgtcgatcgatccggtcagcgatcatcggaagtgggtggcggatatcgccgagacgcagggtcacgcggtcaactatccgctgatcggcgacgacgagctgaaggtcgcgaagctgtacgacatgattcatccgaatgcgagcggcggcccgcgcacggcggtcgacaacgcgaccgtgcgctcggtgttcgtcatcgggccggacaagaaggtcaaggcgatgctcgtttatccgatgagcgcgggacgcaatttcgacgaggtgctgcgcctgctcgacgcgttgcagctcaacgcgcagcatacggtggcgacgccggtcaactggcggcccggcgacgacgtcatcattccgacgtcggtgtcggacgatgcggcgaagcagaaatatccgcagggcttccggacgctgaagccgtacctgcgttacgtgacgcagccgggctgacgcgccgtgccggccggatgccggcagtgcaggaccacgacggggcggcccgcgcggcggccgcggcgacagcggcggcgcgggccggacaatgcgcatcaaccagcgacggagcgacttcgcgatgatcttccggcaactcttcgacccgcaatcgtcgacgatacgtacctgctcgccgaccgcgcgtcgcgcgaagcgctgctgatcgatccggtgttcgagcaggtgcgccgcgacgcggcgctgctcgacgagctcgggctgcggctcgtcgcgaccgtcgacacgcacgtgcatgccgatcacgtgacgggcgcgtggctgctgaagcagcgcacgggcagcacgatcgcgatctcggccgcgagcggcgcgcagggcgccgatcgttacctgaacgacgacgaccgctgtgcgttcggcgcgcgctacctgaccgtgcgcgcgacgcccggccacacgagcggctgcatcagcctcgtgctcgacgacgaatcgatggcgttcaccggcgattgcctgctgatccgcggcaccggccgcaccgacttccagcagggcgacccgcgcgcgctgtatcgcgcggtgcacggccggcttttcacgctgccggccgcgtgcctgctgtatccggcgcacgactatcgcgggctcacggtgacgagcgtcggcgaggagcggcgcttcaatccgcgcctcggcggcgatctgagcgaagacgatttcgcgggctacatgcgcaacctcgggctcgcgcacccgcgccagatcgatgtcgcggtgccggcgaatctgcaatgcggcgtcgccgcgaacgcgcccgatgcgcaggcggcacccgactgggcgccgctcgtctatacgttcgccgggttctgggaaatcgatccgcaatggctcgaggatcatttgcaggcggtgcaggtggtcgacgtgcgcgagccggacgaattcacgggcccgctcggtcacctgcccggcgcgatgccgattccgctcggcgaactggccgcgcgtgccggcgagatcgcgcgcgaccggccggtcgtgaccgtgtgccgggccggcgggcgatccgcgcaggcgaccgtgatcctgctgaaagccggcttcgacacggttgccaatctcggcggcgggatgctgcgctggcgtgccgaggggcgcgtcgtgatggacggccggtcgtaacggcacaagtcgcacgacaaaaattccggaccgctgtcgaaacggccgggtgccgttcgtcgtcaaggtatccgatcacgtggcgccgcacgacgcggcgccgaaacccggagagaccgcacgatgataccgacgctttacgcccatccctttcgtcctactgccagaaggtgctgaccgcgctgtacgagaacggcacgcccttcgcgtatcgcgtgctcgcgcacgacgatccgaagccgatgcaggaactggccgcgctgtggccgttgaagcgctttccggtgctggtcgatgccggccgcaccgtgatcgaggcgtccatcatcatcgagtacctcggcctgaaccatccgggccccgtgcggctgctgcccgacgatccgcacgcggcgctcgaggtgcgcacgatggatcgtttcttcgacaactacgtgtcgacgccgcagcagaaggtcgtgttcgatgcgctgcggccggaagccgagcgcgatgcgcgcggtgtcgccgatgcgcgcgcgatgctcgacacgtcgtatgcgtggctggacaggaagatggccgatcgcgaatgggcggccggcgaccgcttcagcctcgccgactgcggcgcggcgccgttcctgttctatgcggactggacgcaccggatcgatccgtcgttcgcgaacgtgatcgcgtatcgcaagcgtctgctggcgcggccgtcgtttgcgcgcgcggtcgacgaggcgcggccgtatcgcccgttctttccgctgggcgcgcccgatcgcgactgaacggcgcgggcgtcgcgcggcgcgccgacgccgcgcatggccggcagcgcgtgccggggcgacggaacgaaagcagcggcagcatcgcggcgtctcccgttacatcgtgcgggtggccgactgcgcgagcgtcagcagttcgtcgaactgcgtgatcagctcgaagcacagcaggaacgcgagcgtataggccggcgcggggaagcgccggattgtcgccagcacctgcggcgcgaagcgcgagcggatcgcgtcgcgcgtcagcagccatgcgatcgcgatgccgatcgcggcgccggcgatcaggtcggtcgggtagtgaaagccgagataggcgcgcggtacgcagatgaacacgaccgcatacagcagcgcgagcacgccgacgcggcgcgcgatgatgaagatgccggtggcgatcgccatccacagcatcgcgtgatcgctgggaaacgaactccatgcctgtagcgtggccgcgcgcagggctgccgacggaagtgcaggtgcagttcggggttgtagatcggccgcacgcggaacggcagcacctgggcgagcagccggccgaacgcgagcgcaatgagcccgctcgcgatcgtcgcgacgaccagctcgcgctgccgctcgcggttcgggcccggctggaaccacagccagcacagcacgggaatgagcacgaagcccttgaacgtgtacaggcccgcgatcacgcggatcgcgtgattcatcagcggtccgaacgtgatgtgggtgaggaaggtctggatcgtggtatcgaaattgttcatgtcgtgcgatcccggcggacgcccggtgcatcgcgcgcggccggccggatctggaagcgcgctcgcacccgagcgcaacgggggcaagtatgtcacccgttatttcgaagaaaatgcgaaaaataccgggaatcccctgatgaaacggggctgtgcgatggggccggatgggcgagcgccgtgtggcgggggatcggaatcgtccgatatttccgcgtcgatgcgcgcggtcatcggaaaaataatcggtagaactggacagtcgcgcgggctggtgtggatcttgcactggatgagcggttctcgcgccggatgcgcgcgaatctgccgggccgcgcggcgtcatgcgtgcgccgatcgaaaataaagaaaaggcgggcaagcccaggggcctgcccgccacgtgcgtgcggtgcggaaattcggcggcgccggattcgtgccgtgagcgccgggcggccgcggcgccgtcagccgcgccggatgccttcgggcagtgcgctgatgcggcgcacttcgggcgaatcgagccacgcgcgcgacgtcgcgcagtcggcgaacatgtcggtcgcatcctcgccccagaacaggtcgccgtcgagttcgaaggtcggcacgccgaatacgccgtgcgcgatcgcatcgtcggtgttcgcgcgcagcgcgtcctgaccggctgggcttcgacggccgtcacgccctcggggccgacggcttcgcacagtgcggcgaagccttccggcgtcgacacgtcccggccgtcgcgccagatatgccggaagatccggcggatcgcgtcgggtgaactgcccatcgcgatcgcgagacgcagcggcctgatcggattgaacgggtgcgcgggcggcatccggaacgtaatgccgagcttgtccgcgcgatattgcgcgtggcgataggtgaagacgcgtttcgccgcgatctcggccggcgctttctggccccagcgtgagcagtgcgccgagcacgatgggccgcggctcgaacgcggcggcggccggcaaccggtcgaattgttcctgctgcaggtaggcgaatggcgacacgaaatcgaaataccagatggcggtgcgcgcggcgttcatggtggctgccctcatgggtgtccggttggcggtggcatgcgcggcacgcccgcaggcggcgcgcgatgcatgcatcggcggccagtgtcgcacgcggctgccctttgcgttgttgctgtagcgctgttgcgtggcggggcgcgcgccaccggtcatgacgccgtgtcgccgtggcccgctgccggcgcgaactgcgcgaggctgtcacgtacggccgccgcatcgtagcgcgcgcctgcgccgccgagcgccacggtcgccttctgcgcgagcggcagcagcatcgcgagcgctgccgccatggccggtgcggcggcgagccgcgatttcgggcccgacacggtcagcgcgccgacacactcgccggccgcaccgaacacgggtacggacgccgaagccgtctcggggtcgcgctcgccgtacgacgcggcccagagtcgttcgcgcacgtcgtgccattgcgcatcctgcgtgtcggtgaacgccagcagcaccttcccggacgcgccctggcgaaccggaaattcctcgccgacacgaatcgacacgcgcaccgcgcgggcgggctcgacccggtacagcaccgagcgcatatcgccctggcgcacgtagaacgatgccgtttcgccgagttcgcggctgagcgtttcgagcagcggctcgaccaccgggccgacccggaacgaacgctggtacagcgcggcgagccgcagcggctcgtgcccgatcgcgtactggccgtcgtcgagcttgcgcatgaagccaccatgctcgagcgcggcgagcaggcgcaggatcgtgctcttgtacagcccggtgcggcgcgacagctccgcgagcgacagccggtcgtcggtctgcccgaaggcgcggaggatcgcgaacgcgcgatcgaggacggcgacgccgctggacgcttcttcggccggcgaatcgggctcgctgccggcgtgatcggtgtgagtcgtaggcactgcctgcttccttcagaggatgatcggtcgactatatcgttctgcctgacagaactcaagttccagaaaatcgcaatttcgcgggtaccccgcttacagcacgttcgacgcacgcttagagttctatcaaacagaacgatgttctttcagatagaacgatggagtatcaaatgagcgtttccgaatatccgaaggtgctggtcagcgaggtcgggccgcgcgacggcctgcagagcatccgggccgtgatgccgacggccggcaagctgcgctggatcacggcgctggccgcggccggcttgcgcgagatcgaggtcgggtcgttcgtgccggcgaggctgttgccgcagatggccgacgtgcgtgaggtcgtcgcgcatgcgctggcgattcccgggctgcatgtcgccgcgctcgcgccgaacctgcgcggcgccgagggcgcattcgaagccggcgtgcacaagctgacgctgccggtatcggtgacggaggcgcattcgctggcgaatatccgcaagacgcccgcgcagatgatcgacgaggtgcgcgcaatcgtcgcgctgcgcgatgcgcggttcccgtcggtgcagatcgaggcaggcgtgtcggtcgcgttcggctgcacgatcgcgggcgccgtcagcgacgacgagacgatcgcgatggcggtggcgatggccgaatgcggggtcgacgagatcgggctgtccgacacgagcggctatgcgaacccgcgcaggtgcgccggctgtttgccggctgcgccgggaagtcggcgacaaagcgggcggcgcgcatttccacaatacgcgcgggcaggctcgccaacgtcgtcgcggcgctcgacgcgggcgtgacgacgatcgatgcgagccagggcggcctcggcggttgcccgtatgcgccgggtgcgaccggcaacatcgtcaccgaggatctcgtgttcctgctcgaagcgatgggatacgacacgggtatcgacgtcgacgccctgctcgccgcgcgcgcgatcctgcacgcggcgctgccggccgagacgttgtacggccatgtgccggacgccggtttgccgaagggcttccgttacgcggacggccgttctccagccgcgccgcaaccggaaggatgcctggcgggagtcgcgcaatgaacggccgccaacccgcttcgatgctgccgtacgccggcgtccgcgtgatcgagatgacgcacatggtgatgggcccgacctgcgggatgctgctcgcggatctcggcgcggaagtcatcaagcatcgaaccgatcgccggcgacagcacgcgcgcgctgcgcggttcgggcgcgggattcttcgggatgttcaaccgcaacaagaaaagcctcgcggtcgacgtgatctgcgcgcgggctcgagatcgtgctgcggctcgtcgcgacggcggacgtgttcagcgagaacttcaagagcgggcacgatggaccggtttcggcctcggcttacatccggcgctgcactcgctgaatccgcgcatcgtgtacgtgtcgcacaagggctttgccggggccgtacgagcatcgcaccgcgctcgacgaggtggtgcagatgatgggcggcctcgcatacatgaccggcccggagcggcgcgcgcgggcgcgagcgtgaacgacatcatgggcggcatgttcggcgcgatcggcgcgatggccgcgctcgcgcagcgcgagcgcaccggccgcggccagcaggtgcagagttcgctgttcgaaaacaacgtgttcctcgtggcgcagcacatgatgcagttcgcggtgacggggcaggccgcatcgccgatgccgagccggatttccgcgtgggccgtctacgacgtgttctccgtgaaggacggcgagcagatcttctcgcggtcgtgtcggatacgcagtgggcgctgttctgcgatgcgttcgggctggctgcgctgaaggacgatgcgcgcctcgcgaccaacaacctgcgcgagtggctgctgcccgaactgcgcgcgcggctcgcgccgcattcggccgcggagatcggcgcgatcttcgagtcgatcggcctgccgtatgcaccgatcaccgccgcaggacctgttcgacgatccgcacctgctggcgacgggcggcctcgcggacgtgactttgccggccgatgcgagcagcgccgggcggccggtcgacacgcgcaccgcgctgctgccgctcacgctcgcgggcgagcgcctgcggctgcgctcggcgccgccggcgctcgggcaggacacgcgcgcgctgcttggcgaactcggctacacgccggacgaggcgcgcgcgctgatcgaagccggcgtcgtggccgggcggcacgacgcggacggcgcggcggcgggcggcgcgccgtcgccgaacgaactggcgagcgcgtagcgcggccgcgatcccctgatcgaacaaaggcgtcccgaccgcgccacgcgcgggcgaggatcgccctatccacggagacaaccatgacatccgcattcccggcgctggccgccgatcgcgagaccgatgcatcgatcgagcagcgggccgtgcgcaaggccgcatggcgcttcatccgctgctcgcgctcgcgtattttttcaattacctgaccgcacgagcgtcgggttcgcggcgctcacgatgaaccgcgatctcgggctgacggcgacgcagttcggctggggcgcggggatcatgttcgccggctactgcgtgttcgaggtgccgagcaatctcgcgctgtaccgcttcggcgcgcgccgctggctcgcccgcatcatgatcacgtggggcgtgatggcggccgcgaccgcgcttgcgaccgggccgacgagtttctatgcgatccggttgctgctcggtatcggggaagccgggttctttccgggcgtgatcttcttcctcgccgtgtggtttccggcgagctaccgcacgcgggtgctggcgtggttcaccgtgtcgacgccgctgtcgtcgctgatcggcgggccgctgtcgacgtggctgctgcagctcgacggcgcgctcgggctggccggctggaaatggatgttcatcgtcgaagggctgccggcgcgcgctcggtttctcgtgctgaagctgctgtccgattcgcccgcggatgccgcgtggctgtcgagcgacgagcgtgccgcgctgcagcgcgcgttcgagcgaaggcgcggccgccggccgcaagaagcgcttcggcgtcgcgctgcgcgacgtgcgcgtgtacgtgctcgcgctgatctcgttcggtttcacgatgggttacgggatcggcatctggctgccgcagatgctcaaggcgcacggcatgtcgacgatgcagacgggctggctgtccgcggtgccgtacttcttcgcgaccgtcgcgctgttgtggtgggcgaagcgcgtggaccgtcgcggcggcccggtcgcgaacctggcgatcgggctgttcatcggcgcggtggcgctcggcgtctcgacgcacttcctgacgctcggccccgcactcgccggcatcacgctggcgctggtcggcacgatcgccggccgcacgatcttctacacgctgccctcgcgcttcctgtccggccaggcggcggccggcgggctcgcgctgatcaactcgatcggcgcgctcggcggcttcgccggcccttatctcgtcggctacctgaaggacggcttcggcacctttaccgccggcatgttcggcctcgcgatcgtgctcgcgatcacgacgctgctgacgctgtcgctgtatgcgttcgaccggagcgaatgacatggacacgacgctttcgatcaagcggcgccggctgctcggcgcggccgccgcatcgctcgcgctgcccgcgttcgccgagacgcgcgcggcgacccaggagggagtttcccgcatgacgatgcaaagcaactatctggcggtccgccccgactggctcgcgtcggcgctcgaacccgtgctcgagcccgacctgccgatcgtcgacgcgcatcaccatttctatgagcggccgggctggatctacatgctcgacgactatctgcaggatgcgcgctcgggccacaacctccaggcgtccgtctacatgcaggcgcagacgcgctatcgcgatgcgggcccggtcgaactgaagccggcgggcgagacggcctacgttgccggcgtgaccgagccgttgcagcagcacggccgcccggctgtcgcgaaaggcatcgtcggccatgcggacctgcgtctcggcgagcgcgtgcgcgaggtgctcgaagcacatctcgaagccggacgcgggcggtttcgcggcgttcgtcacctgacgacctgggatgccgatccgacgctcgccaatccgctatcggcggtgccgcgcggcatgctgctcgattccgcgtaccgggcgggcgtcgcgcagctcgcgccgctcgggctgtcgtacgacgcgtggctgttctttcccagctacctgaactgttcgagctcgcgaaggcgaatcccgatacgcgcatcatcgtcaatcactgcggcggcgtcgtacggatcgcgagttatgccgacaagcggccggaggtgttcgagcgctggtcggcgtcgatgcgcgctcgcgccgccgaacgtgtacgtgaaggtcggcggctcgggatgcgcatcaacggtttcgatttcgagaaaggcgcgcggccgccgtcttccgtgcaactcgccgacgcgtggaagccgtggatgatgacctgcatcgacgcgttcggccccgagcgctgcatgttcgagagcaattttccggtcgacaagggctcgtattcgttcgtgaacggctgaatgcgttcaagcgcctgacggcgcaggcaagccggacgagcgcgacgcgctgttccgcggcacggtcacgcgggcttaccggctcggctgacgcgcgtcgcgacgacaggcccggcgcttgctcactccgcttccaccagcgccgccagcctcgccagcgccatttgccagccggtcggcgaccggcacgccgggcggcaccccgtcgtgcacggcgtccacgcgcgtgccgcccgcttcgtcggacagcgtgatcgtgatcgtcatggcgcgcgcagcatcggatcgtcggtttcgaacacgtcgatctcgacgatctgctcgtccggcacgagcgtgacgaagcggccgtgataggtatcggtgcgcgcggtggtcttgccggtgccggccgacggtgcgtcatagctcagcgacacgcgcagcgcgccgccttcgcgcgtcgtacgcatgcacgcggcacgtcatgccgtcgggcaccttccattgttcgacggcgtgcggatcgagcagcgcggtagacgcggccgcgcgcgttcaggtgccggctgacccgggtcgaatgcgtgtgcgtgcaacatgtcgcctccgcggagcgcgcgcgacgacgtgcacgccggcggccggcgtgtcgtcgcgcttccttcaggaatcctggcgcgcacgaggcggcatgcaatgatcgcgcacccggccgcgctcagcgcagcgcggccgcgaaggcgtcgagctgcgtgatgcaagtgttccagccctcgaagaagccgagcgcttcatggcgctcgcgcgtggcggcgtccggatgcatcacgcgcgcctcgtagcggctgcccgcatcgtcgtcggccatcgtgatgactgccgtgaaccccagccacggcaccggccgccagccgcccgcgagcatcgacgtgaacgcgatgcgcgatcgggcacgatttcgaggaagcagccggggttgtcgctcgtgccgccgtcggggccgcgcatggacgtgtggaaagcgccgcccggacgcaggtcgaatgcgcgcacttcggtggtccacggtttcgggcaccaccattccttcagcagttcggtcggtccacgccacagcgcgtggcgcggcgcgtaacgtgcgcgtgatgacgagatcgtgggcttcagcggggtcgaggctggctgacatcgtgctcctcctggtgacggcgttcgacgaattcgacgagacgatcggatcgtgcttcccacagcgcgcgttgcgcggcgagccatgctcggcctcggcgagccggctgccgaccagtgtgcaggtgcgcgagcggccggatttccggttcgcacgaggccgctgcgctcgagcacggccacgtgcttcatgaacgacggcagcgccatgtcgaacggctcggccagtgcggagacggtccgctgccctggccgagcgcgccgacgatcgcgcagcgcgtcggatcggcgagggcgtggaagacgtcgctgatgccgggttgaaagttagccatgtggctaagtgtaggcaatgcgaacggcgatgcaacggaaattttcgtcgcgtaggatgatggggcggtaacacgcgccgaccggggcgcgtatcgccgcatgcctgctgccgttgcgcgagccgcgacgatcggccggtgttctttccgatccggccgcccgccgaaccgtgcgggcggcccacctgattgggatggcatgaccgaacgttaccgtccgccgcgtcgacgcgggcgaagcgatgacctgcgtcgatgcgctggccgacgctgatcgattgcgtcgagggcggcgcgtccgtcagcttcatgttgccgatcgggcggccgaccgccgtcgcgttctggacccacgtcgcccacggcgtcgcgaacggcgagcgcatcctgctcgttgccgaggacgcggccggccggatcgtcggcaccgcaggtcgtgaccgcgcagccggagaaccagccgcatcgcgcggatatcgcgaagatgctcgtgtcgcggcacgcgcgccggcagggcatcgccggcggctgatggcggcggccgacgcggccgcgcgcgacgccggcaagaccgtgctcgtgctcgataccgtgacgggcggcgacgccgagcggctgtaacgagcgggccggctggcagcgcgtcggcgttgtgccgaactatgcgttgatgcccgacggcacgccctgcgcgacgacggttttccacaagcaactcgcgtaacgggcgcgcgatgcatcccgtcgctcccgcgctcctgttccttacgctcgcggccggtctcgtcgcgctgctcgcgcctgcgtggctcgcggccgcggcgacgccgcacgcaggtgccgcttcgcgtgtttttctacggatgctgaccttcgtgttccagccggtactgcgcatgtcgtggcagattccgctgtaccgctggcttgctcacgacccgcgctggcacttgccgatgctcgtgttcgcggcattgacggccgggctcttcgaggaatgcgggcgctgggtcgccttccgatatctgctgccgaagcggcatgatgcgccgacggccgtgatgctcggctcgggcacggcggactggaggcgatgctgctgtcggcgtcgggtttcgcgctcggcacggcttatctcgccgcgcacgcgggtgtcgggtgcctgagggcgtgcagtcgctggtcgggtcgcagttcgcgggcatgacgctcgcgtcgcccgttctcgcgttgctcgagcgcacgagcgctggccgcgcatggggctgtcgctgatcaacggcgacgttcgtgcgcggaacgaagcgctggctggtgtatgcgattgcgcttcatttcgtgttcgacctcgttgctgtgctgctgacgcggtactggcatgtcgatacggtgctggtcgaggcgaccctgttcgtgtgcagtgtcgccctgttgctgggcattcgctggagccgccgggcggcgggagcggaggcgcgagcacggggcacgtcgcgacgggcagggcgtgtcagccgtttgcagtggattcgggctgccggatggcgggcgcatctgattatccaggcggcatcagcgggaaaaaggtccccggttcgacgaaacggcagatcgcaacggcaagcgccggaatgtcagccatcagattgtgtttgttagtcgcttttttttttggaattttttttggaatttttttttgcgctaacaacctcctgccgttttgcccgtgcatatcggtcacgaacaaatctgattactaaacacagtagcctggatttgttctatcagtaatcgaccttattcctaattaaatagagcaaatccttattggggtaagacatgaagatgccagaaaacatgacctgttggccgccattctcgcggcaaaggaacaaggcatcggggcaatcctgcgtttgcaatggcgtaccttcgcggcagatataatggcggtgcgtttacaaaaacagtaatcgacgcaacgatgtgcgccattatcgcctagttcattcgtgaccttctcgacttcgccggactaagtagcaatctcgcttatataacgagcgtgtttatcggctacatcggtactgactcgattggttcgcttatcaaacgcttcgctgctaaaaagccggagtagaagatggtagaaatcaataatcaacgtaaggcgttcctcgatatgctggcgtggtcggagggaactgataacggacgtcagaaaaccagaaatcatggttatgacgtcattgtaggcggagagctatttactgattacccgatcaccctcgcaaacttgtcacgctaaacccaaaactcaaatcaacaggcgccggacgctaccagcttctttcccgttggtgggatgcctaccgcaagcagcttggcctgaaagacttctctccgaaaagtcaggacgctgtggcattgcagcagattaaggagcgtggcgctttacctatgattgatcgtggtgatatccgtcaggcaatcgaccgttgcagcaatatctgggcttcactgccgggcgctggttatggtcagttcgagcataaggctgacagcctgattgcaaaattcaaagaagcgggcggaacggtcagagagattgatgtatgagcagagtcaccgcgattatctccgctctggttatctgcatcatcgtctgcctgtcatgggctgttaatcattaccgtgataacgccattacctacaaagcccagcgcgacaaaaatgccagagaactgaagctggcgaacgcggcaattactgacatgcagatgcgtcagcgtgatgttgctgcgctcgatgcaaaatacacgaaggagttagctgatgctaaagctgaaaatgatgctctgcgtgatgatgttgccgctggtcgtcgtcggttgcacatcaaagcagtctgtcagtcagtgcgtgaagccaccacgcctccggcgtggataatgcagcctccccgactggcagacaccgctgaacgggattatttcaccctcagagagaggctgatcactatgcaaaacaactggaaggaacccagaagtatattaatgagcagtgtagatagagttgcccatatcgatgggcaactcatgcaattattgtgagcaatacacacgcttccagcggagtataaatgcctaaagtaataaaaccgagcaatccatttacgaatgtttgctgggttttgttttaacaacattttctgcgccgccacaaattttggctgcatcgacagttttcttctgcccaattccagaaacgaagaaatgatgggtgatggtttcctttggtgctactgctgccggtttgttttgaacagtaaacgtctgttgagcacatcctgtaataagcagggccagcgcagtagcgagtagcatttttttcatggtgttattcccgatgctttttgaagttcgcagaatcgtatgtgtagaaaattaaacaaaccctaaacaatgagttgaaatttcatattgttaatatttattaatgtatgtcaggtgcgatgaatcgtcattgtattcccggattaactatgtccacagccctgacgggaacttctctgcgggagtgtccgggaataattaaaacgatgcacacagggtttagcgcgtacacgtattgcattatgccaacgccccggtgctgacacggaagaaaccggacgttatgatttagcgtggaaagatttgtgtagtgttctgaatgctctcagtaaatagtaatgaattatcaaaggtatagtaatatcttttatgttcatggatatttgtaacccatcggaaaactcctgctttagcaagattttcctgtattgctgaaatgtgatttctcttgatttcaacctatcataggacgtttctataagatgcgtgtttcttgagaatttaacatttacaacctttttaagtccttttattaacacggtgttatcgttttctaacacgatgtgaatattatctgtggctagatagtaaatataatgtgagacgttgtgacgttttagttcagaataaaacaattcacagtctaaatcttttcgcacttgatcgaatatttctttaaaaatggcaacctgagccattggtaaaaccttccatgtgatacgagggcgcgtagtttgcattatcgtttttatcgtttcaatctggtctgacctccttgtgttttgttgatgatttatgtcaaatattaggaatgttttcacttaatagtattggttgcgtaacaaagtgcggtcctgctggcattctggagggaaatacaaccgacagatgtatgtaaggttaacgtgctcaaatcttcatacagaaagatttgaagtaatattttaaccgctagatgaagagcaagcgcatggagcgacaaaatgaataaagaacatctgctgatgatccctccgtggatctgattcgtgtaaaaatatgcttaatagcaccatttctatgagttaccctgatgttgtaattgcatgtatagaacataaggtgtctctggaagcattcagagcaattgaggcagcgttggtgaagcacgataataatatgaaggattatttctggtggttgactgatcaccataactgctaatcattcaaactatttagtctgtgacagagccaacacgcagtctgtcactgtcaggaaagtggtaaaactgcaactcaattactgcaatgccctcgtaattaagtgaatttacaatatcgtcctgttcggagggaagaacgcgggatgttcattcttcatcacttttaattgatgtatatgctcttttctgacgttagtctccgacggcaggcttcaatgacccaggctgagaaattcctgaccctttttgctcaagagcgatgttaatttgttcaatcatttggttaggaaagcggatgttgcgggttgttgttctgcgggttctgttcttcgttgacatgaggttgccccgtattcagtgtcgctgatttgtattgtctgaagttgtttttacgttaagttgatgcagatcaattaatacgatacctgcgtcataattgattatttgacgtggtttgatggcctccacagatatgtagatgataatcattatcactttacgggtcctttccgtgaaaaaaccaaaaacatcgtcgtgagtagtgaaccgtaagcagcaatacgtaactgaacgaagcaccgcatcgccgaaatcgagcgtcaccagccgtgcgcgcgccgcgtgaatccggtcgccgagtgcgcgctgcgcggaggcatggcgcgcgcggaacgcctcggatcgagatcgaaggcaagccggtgccacgatccgctcgcgcacctcggcagttcgccagttcgaccatcaggcccggcggtcgaacgattgcggaccggctcgcctcctcgggattcatcgtgccgaagaacgaagcgcgcgtcgtgcgcatgcgacacgccatcgcgttcgacgatgttcacgccgctcgcggcgacaccgatcccgaagcagcgtatcgaccaggcccgtcggcgagcaggttgccctcgtcgacgccctggcacgccggatgcgcgcgagcggcccggcggaagcgcacgcgtttcggcgagtgcatgctgagtcgagcgtccccgtcacctgctcgtcgctcgccggcagcggcagcgtgacgaactgcccttccggcaacaactcggcgaagacgcgcgcggcggtcgatttcgcggtgccgcgcgggcgctcgacgcaccgccgagcgacgggtcgatcgcggcgagcagcagcgcctgcgcaacgcgtcctgtgcgacgagcgccgcaaacggaaaaaccgcgcgcgcgcggtgcgtcgtcggatcggtcatcgccgtcccccttctggagttgttcgctgtccaggccagaccgcttcgatccgctcgcgatagtcgcccggctgctgccacaggccgcgctgcatcgcctcgacgaagcgttcgcagatgccgtgcagccttcggttgtgccgttcgaggaacgcgcgggtggcgtcgtcgaacaggtacgcgtcggcgacgagcgcgtgctggtggtcggacagcacgcgcgcggtcgcgtcatagccggcagggtagtcgacggtcgccgccagctcggccgcacccttgtaaccatggcgcttcacgccgtcgagccatttcgggttgacgacgcgcgaacggatcacgcgcgcgatttcctcgcgcagcgtgcatcttcggcgcgaccgggttcgcgtggtcgccgtggtagatgctcggctgctgcggacaggtgccgcaccgccgcggtcatcccgccctggaactggtagtagtcgttcgaatcgaggatgtcgtgctcgcggctgtcctggttctgcacgaccacgtcgatcgttgcgagccgctcgccgaacacgtcggccgcggcgtcgcccgcattctgcgcatacgcatggccgccccactggcggtacgcctccgcgagatcggcgtcggtctgccagcggcgctggtcgatcaggtcctgcaggcccgcgccgtagctgcccggccgcgccgaacacgcgccagccggcgcggcgccgccttcgtccggcgccacgccctgtgcgacccacttcgcgcgttcgcgctcgatgcgcgcgcggatcgggttccagttcctccggctcgtcgagcgcggccaccgcctgcacgctgcgtcgaacagatgcatcaggttcgggaacgcgtcgcggaagaaacccgatacgcgcagcgtcacgtcgatgcgcggccggtcgaagatctcgatcggcaggatctcgaagtcggtcacgcggtggctgccgtgcgcccatttcggccgcacgccgacagcgcgaacgcctgcgcgatcgtcgccgcccgtgcgcatcgtcgccgtgccccacaccgacagcccgatcgcgcgcggatagtcgccgtgatccgcagatggcgctcgatcagctgctgcgcggatttcaggccgagcgtccacgcggcctgcgtcggcaccgcgcgtgtcgaccagtagaaattgcggccggtcggcggcacgtcggggcggccgcgcgacggcgagccgctcggccccggcgcaagcggccgtcgagcccgcggcgagcgcacatttcctcgccgccgcactgtcgagcgccggcagcgcgcgtcgcgcggacgcgctcgatcacggcgacgtgtgcggccagtcgccgggggcgtcgcgtcttcgcgtacggctgccgtcggctgcacacaacctgtccagccattgctgcgcgagccgttcgagccgctcgcgcgtatcgcccgcgtggcgccacggcgatgcgtcgagcgcctgcaggatcgccggtcgcgggccgacccacggcggcccagtcggccgcgagcggatcgaaatcgtcgccgagcgcggatcgcgcgcgagcgcgccgatcagtcctgcgcgtgcgcccttgccgtcgccgaccggaaagcgcgcgagcgccagcagcgtgtcgcgccgctggcgcccggccggcgacgcgcgaacacgtgcagcccgtcgcgaatctgcgcttccttcagttcacaagccgcgcgtcgacgcgcgtcagcagcgcatcctcgtcgcccgcgtcgcgcggcggcgacacgctcagctcgtcgtgcagccggtgttcggcgatcgtcgcgaggatcgtcttgcgcagcagcttcgcgccgcgcatcgaccatcagcgcttcgtagtattcgtcgacctgccgctcgagatcctgcagcgggccgtagttttccgcgcgcgtgagcggcggcatcaggtgatcgacgatcacggcctgcgcgcgcgccgcctggctgccctcgcccggatcgttgacgatgaacggataaagatgcggcagccgggtcaggtcgggccagcacgcgtcggacagcgcgacgctcttgcccggcagccattcgaggttgccgtgcttgccgaggtggatgaccgcgtcgatgcgatacgcatcgcgcagccagaaatagaacgcgagatacgcatgcggcggcacgagatccgcgtcgtggtagctcgcgtagtcgttctcgccgcgcgagctgacggctggatgccgacgaacacgttgcccgcgcgccagccggcgatcgtgaagcgcccttgccgcagcgtcggatcggcttcgggcggaccccagcgttcgttcagcgcgtcgcgcacggccgccggcagccgcgcgaaatgcgcgacgtagtcggccagcgggaatggaaggcggggcgcagcgcatgcacggccgcatcgttggtcacgccttcggtgagccgtgcgatcagcgcgtcgccgtcgggcggcaggtcggccaccgcatagcccgcgtcgcgcagcgccgcgagcacgcgcagcgcggacgccggcgtatcgaggcccgacgccgttgccgatccgcccttcgctttgcggatagttcgcgagaatcagcgcgacgcgcttggtcgcgttgtcgagcgtgcgcagcccgcaccagccgcgcgcgagcgccgcgacgaacgcgatccgctcggcgtccggctggtagcgcacgacgtcgacctcggtgtgcgggcagcggtacgcgagccttgaagctcaccgcgcgcgtgacgatccggccgtcgacctcgggcagcgcgatgtgcatcgcgatgtcgcgcgcatgcaggccctggttgtcggccacccacgcgtcgcgattgccgccggacaggatcacctgcaataccggcgcgtcgccggcgagcacgtcgtgttccgggctgtcgatcgcgccggccgcgaacgcggtcgtgttcagtacgagtgcgacgtcgtgcgtgtcgcagagctgcgtgatgacttcgcggctcaccgcatccttcagcgacgtgaccgcgaccggcagcggattcagcccctcccgcacgagcgcatcggccagcgcatcgaacacggccgtgttcgcggcctgccagtgcgcgcgatagaacaggatcacgacgacgggcgcgccaggcgtccagcgcggccgccagtcgtcgacgctcgcgcggtcgcgcgccgggtgatacagcgcggcggccggcagcgggcgcggcggttcgggttcgtcgccgaacccgagtgtgtggaatgcgatgctgcgcagcgcgcctcggcgttgtgcacgccgccttctcgcaggtagcgccaccacaaccggctggagccgggcgcgacggtgctcttcgcgacgaggttcgggtcttcctgcggtcgcccgagaacatcgcgagctgctgcgcgcttcgacgcgagcgacacggcctgctcgatcccgtacggccagtacgcctcgccgccgagatggtcgatcacgaccgccttcgcgtgctgcaacacgtcgtcgacgtagaaatcgaccgacgccggctgccgcaggaacgtgacgctcgcgagccgcacgctcgggaagccggccggcaggtgcggcacgacgctggcaagcagcgacagcgtcgtgtcggccgagctcaggatcacgatgtcggccggctgctggtcgatccggacgacaccctgcgtatcgtcgacgaagccgcccggcgtggtgcgcagcagatgcatcgtgcgttacgcctgttgcggctcggcgcacgcggcgtcgaacgcgcgttgcagcgccgccgcgtcgagatcctcgccgatcagcacgaagcggctcgcgcgggtttcgccgtcctgccagcgacggtcgaaatagctgtcgaagcggcggccgacaccctggatcacgagccgcatcggtgcgccgggcagcgcggcgaaacctttcgcgcggtagatcgtatgcgcttcgacgacgcgctgcagcgcggcgatcgtcgcctcgcgcgtgccggcgtcgccggacacgaccagtcgaaatcgtcgtgatggtggtcgtgatcgccgtcgtcggccgagccgtgatggtcgtggcgcaggtggatcgtttcttccgatgccgattcgaggccgagcagcatcgcgagatcgagctcgccgcgcgtcgcgcacgatcttcacctgcggcgggatctcgtcgcggatcgcggtttcgatctgcgcaaattccgcgtcgccgacgagatcggccttgttcacgatcacgagatcggcggacgacagttgatcggcgaacagctcgtgcagcgattcgtggtcgaggttcggatcggcgcggcgctgcgcgtccacggcctgcgggttttccgcgaactggccggctgcggcggccggcccgtcgacgacggtcacgaccgcgtcgaccgtgaagctgttgcggatcgtcggccagttgaacgcctgcacgagcggcttcggcagcgcaggcccggacgtctcgatcagcacgtggtcgatgtccgcgcggcgctcgacgagcgcttccatcaccggatagaactcttcctgcacggtgcagcacaggcagccgttcgcgagttcgtagagctggcccgacgcttcgccctgcgcaccatcggcatcctcgcagccgatgccgcaacccttgaggatttcgccgtcgatgccgagttcgccgaattcgttgacgatcaccgcgatgcggcggccttcggcgtgctgcaggatgtggcgcatcagcgtcgtcttgccgctgccgagaaagcccgtgacgatcgtgacgggaagcttgcgtagggtcatggtaggtcctgtgtcgaaaaaggaatcagcccgggatcgtcgcgtcgatggcggcgtggcagttcatctggcggatcgcgggcatgccgccgcgcgatccggacggacagtcgcgggacgggcggaacgacgaatcggacatggtgcttccttgcgaacggtcgacatcgtgaatgccaacacggctgccgccggccggctcgcgcgcctgccgttcaccgcgccggccggcgcgggttcgccagcggcagatcggcggtggaaacgagcaacacgcgggcgtcgggccggctgcggccgtggacgatgcgccgcctcccgcggcgctgaaccccaacgtttgggccggtatccgggctggcgaacacgccgcttcgccttcccggatgcacaacaatccagtggcggtcgtccgcatgcgcgcatgcggcgaagcggcgctgcgtggcgctgcgcgcgacgcgttcgcttaccgttgcgggggcagcacaggttggctcgactgcggcgcaggcaggctccctgtttcccgtttaactgcgcgcaccggagcggcgcgcgagcaccaaaacgcgtgcgagtgtaggcggcggtgcggggagcgtcaaggcaaaacgggccgccgggcccggttccggaggaccgccgcgcgcggccggacgccgcgcacggcggttcgcgcgggtggaccgctgtgctatcgtagcgccgcgttcggtgctcgcatgcgcattccgtgcatgcagttaaacgggaaacaggaggcggatcgccgccctgcctgtgctgtccccgcaacggtacgccgcccgcgcgacgcgcttccccgcgcacgcgcccatgccgcccacgatgccactgcccgtccaccgggcgggaaggctgcggcctggcaagcggccagcccggataccggccgacgcaggggcgagcccgatgctcgccgaacgcccgatccgcggggacggatcgagtgcgcattccgcccgcgtccgcgcgggcttcgtcgatccgtcatgcttcacctgtctgctggccgccgccctcccgccttcccgtttccactgtttcgacacggtgcgcgccgtgccgcgccgatgagccgcgcctggctcatcggcgccggccccggcgacgccgacctgctgacgctcaaggccgtccacgcgatcggctcggccgacgtgctgctcgtcgacgatctcgtgaaccccgacgtgctgcgccatgcgcgcgccgatgcgcacatcgagcacgtcggcaagcgcggcggtcatgcatcgacgccgcaggaggtaatcgtcgcggcgatgctcgcgcatctgcgcgcgggccgcagcgtcgcacggctcaagggcggcgacccgttcgtgttcggccgcggcggcgagggctggccgcgctcggcgccgcggatttcaagtcgaggtcgtgagcggcgtcacggcgggcatcgccgcgccggccgcgctcggcattccggtcacgcagcgcggcgcgcagggcgtgatcttcgtcacgggccacggcgcgggcgccgacgaacccgactggcgcgcgctcgcgtacgcgcatgacgatcgtcgtctacatgggcatccgccggctcgacacgattgcagccgcgctgcgaggcggcctgcccggcgacacgccgtgcgcggcgatcgagaacgacgcgccccgaacagcggcacgtgctcgcgacgctcgacacacgctcgagcgtgtcggcgcgaccggcatcggttcgccggcgatcgtcgtgatcggccgcgtcgcggcgttcgccaacgatcccgcggtacgcgccgcactcggcggccgcgcgtgatgcgcgtcgcgatcggtgtcggtttccgcgcgggcgtgacggccgcgcaactcgatgccgcgatccgcatcgcgctgatgcggtacccggctgccgaaccggcgctcgtcgccacgctcgccgacaaggcgcgcgcacgcgcgctgcgcacgctgtgcgcgagacgcggctggccgctcgtcgcgttcgacgcggcacaactcgcgagccgccccgaactggccgtgagcggcccgtcggatgccgcgctcgcccgcttcggcgtcgcgggcgtggccgagccgtgcgcgcagctcgcggcgccgcacggccggctgctgggtcccaaatccatccgggacggcgtgacggtcgcactcgccggcccgctctgaaccctttgtttcgctttctttcgacaggacgaatccgatgaaaaccgacgccgaatcccatcaacggatgaccgaacgccgccgcgcgcctacgaagaagcaggccgccgccgtcaacgaaagggcctgctgatcgtcaacaccggcaacggcaagggcaagagcacggccgcgttcggcatggccgtgcgcgtgctcggccacggcatgcggctcggtgtcgtgcagttcatcaagggcgcgctgcacgtccgagcgcgacttcctcggcgcggttgccgagtgcgatttcgtgacgatgggcgacggctacacgtggaacacgcagaaccgcgacgccgacatcgcgaccgcgcgcaagggctgggacgaggcgcgccgcatgatcgaaagcggcgactaccggatggtgatcctcgacgagttgaacacggtgctgaagtacgatacctgccgctcgacgaagtgctcgcgacgcttgccgcgcgtcccgattcggtccacgtcgtcgtgaccgggcggcatgcgcccgatgcgctgatcgacgcggccgacctcgtcaccgagatgcggctcgtcaagcatccgtacaaggagcaaggcgtgaaggcgcagcgcggcgtggagttctgagcatgcccgcctgccccgcgctgttcgtcagtgcgcccgcgtcgggccagggcaagacgtcggtgacggccggcctcgcgcggctgcaccgccggctcggccgccgcgtgcgcgtgttcaagaccgggcccgactttctcgatccgatgctgctcgaacgcgcgagcgcgccccgtgcatgcgctcgatctcgggatggtcggcgaggccggttgccgcgcgttgcttgccgatgccgcacgcgatgccgacctgatcctgatcgaaggcgtgatggggctgttcgacggcacgccgagcagtgccgacctcgcgactgcattcggcgtgccggtcgtcgcggtgatttccgcgaaggcgatggcgcagacgttcgcggcgatcgcgttcgggctcgcccggttccggccggggctgccgtttcacggcgtgctcgcgaaccgcgtcggctcggcccggcacgccgaactgctgcaacaggcgctgcccgacgacctgcactggctcgggcacgtgccggctgacgcgggcatcgctctgccggagcggcatctcggcctgcaccagccggccgacatcgacgatctcgacgtgcggctcgatcgcgcggccgacgtgctcgcgcagacggcgctcgccgaattgccgcccgccgtcgcgttcgccgaaccggacgccgcggcgccgctgccgcgtgcgctcgccggcaagcggatcgcgattgcgcgcgacgcggcgttttcgttcatctatccggcgaatcgcgctgctcgaggcgctcggcgcgcggttgcgcttcttctcgccgctcgccgacgaacccgtgccggacgattgcgacgcgctgttcctgccgggcggctatccggaactgcatgcggcgacgctcgcggcgaaagacgccaccgcacggacccttcgcgcgcatgcggcggctcgccggccgatcgtcgcggaatgcggggatggtgtatctgtgtgaatcgctgaccgacgtcgacggtgtcacgacgtcgatgctcgggctgttgccggggcgggcgacgatgcagcgccggttcgcggcgctcggcatgcagcagctcgatacgcgtaccgggccgatgcgcggccatacgtttcattattcgacgctcgcgacgccgctggaaccggtcgcgtacgcggcgcgccccgacggcaagccgggcagcggcgaagccgtctatcgccacggcgcgatcgtcgcgacgtacatgcacctgtactggccgtcgaatccggaggcggtcgtggcgctgttcggcggcacggcgttctgaccgaaaaacggcgaggcgccgcgatgtcagggttttcgcggcccggcgcttccgagcgcgaagtgcggatcacggtgccgtcgggcgagaaatgcgcgttgaacatcgcgtcgcccgatacgccgccctcggcccagtgccagctccacacctcttcgtggctcagcgcgtattgcgcgatctcggtcggcttgccgagcagttggcgcacgtcgtccttcgacatcccgggcacgaccttcgcgatgttcgccgccgtcagcgcctgcgtgatcgacacgagccggccgtcgggcccgaaatcgagcatgtaggtgctcgtgccgtacgggccgcgcggatattcgaaccgctgcgagccgtcgtcgccctgcctgaccatttccggcttgcccgcctggcggagcacgtcctcggtcgtcgacacgcccggctgcagattgccgaacgccatcggatcgggcttgatcgcattcaccgcgtcagccactttctggtcgtcgcacccggctgccagcatggcgaccgcacaggcggtcagcacggtcagaagctgttttcgcatttcatccacacctgtattcatcgcgccggtccggcgtcgcgcgcagcgtagcacgcgacctgttccgtcgatgtcaaggagcgtcaaatgcggtcacggccgccgcgaccggttttgcaggcgtggcagctcgcacgccgccgcgccgccgcatcacaccaggaacgcctcggtcagcttgacccagtacgacgcgccggtaggcagtgccgcgtcgttgaagtcgtagccggggttgtgcaccatgcagccgccctctccgtcgccgttgccgatgatcaggtagcagcccggccgcttctcgagcaggaacgcgaaatcctcgctgccggtgagcggcaccatcccgtcgatcaggttcgcttcgcccacccactcgcgcgcgacgccgcgcgcgaacgcggtcatatccgtgtcgttgacgagcaccgggtagcggcgctggtagtcgatcgtcgcggtcgcgccgaacacggcggcctgcgcatgcacgacttccttgatgcgcgtctcgagcaggtcgcgcacctccggcttcagcgcgcgcaccgacaggcgcatctgcgcgcgatcgggaatcacgttcggcgcctcgcccgcgtggatcgcgccgaccgtgacgatcgccatgtcgagcggcgacacgttgcgcgacacgatcgtctgcagcgcaatgacgatctgcgcgcacacgaccaccgaatcgaccgccttgtgcggcaccgcgccgtggccgccgcggccctgcacgtcgatgacgacggtatcggacgacgccatgaacggccccggcaggaagccgaatttgcccgtggggaaccccggcatgttgtgcatcgcgaagatcgcgtcgcacgggaacagctcgaacagcccttcgtcgagcatcttctttgcgccgccgagcccttcttccgctggctggaaaatcaggttcagcgtgcccgagaagcggcgctcgcgcgcaagatgcttcgcggcggcgagcagcatcgccgtgtggccgtcgtgaccgcatgcgtgcatcttgccggcgatcttgctctcgtacggcaggcccgtggcctcgtggatcggcaacgcatccatgtcggcgcgcaggccgaggcgctgcgtgccgttaccgaccttcagctgcgcgacgacgcccgtgccgcccagcccgcgatgcaccgtgtagccccacgactgcagttgctcggcgacgaggtcgctcgtcgcgaattcctcgaagccgagctcggggtgggcatggatgcggtgccggatctcgatcatttcatcggcgaggcctgcgggaatcacgctgtgcgtcacggtgtcgtctcctgtttctgcgggaatgtgcaggcaaggatagtcggttcgccggcaaccgggcagacgaaaagtcgtcgcggtagcaaccaacggttgccgtttctggtaccgcgcacgatatgagttaaccggccatccgggtgactgccgcacacggttcgggcgcgtgagactgtgggcttgacagcgatttgacgagcgccaggattcgacgatgaccgttcgagcatccagaataatgccgacacatcaatgtgttacagacaattgttcatttttgacgcctgtacatttttgtgtacgctgatgaggaagtgaacaagcaatcgcctccgatgcccgagaacgcccccttccgatgtcggaacagcacgtgctcgacgaagcctgcgccgcgttcgaacgcgcgacccggcgcttcggcgcgcggcccgtgcgcgtgccggccgcgtatgccgggcaagccgacgcgatgatccgcttcgacgttgccgggcacgtattcgagatgccggccgccgtgagcctgcgcgtcgaatcgctgccgggcgcactcgcggcactgcgccgccgcggcggtgcgaccacgacacccggcgagcggccgctgatgctgatcgcccctatctttcggccgaactggccgccggcctgaccgaccagggcatcccgtttctcgacaccgcgggcaacgcatgcctgatccagccggaagcgaccgtgatgatcgcgggccggccaaaacccgcacgcacgccgcgccggcaggcatcgcgcgcgacgacgccgaaagggctggccgtgatgttcgcggtcgcgacacagccgggcctcgtcgcgcagccgtatcgggcgattgcggccgcatcgggtgtcgcgctcggcacggtcaaccttgcgatggacgacctgatcgcgcgcggcctcgtcgggcagcgccgcaatggcgagcgcctgatacccgactggccgcgcttcgtgcacgaatgggttgcgctgtacccgagccgcctgcgcgcgaaactgccgagccgtcgttatgccagcctcgcgcccgactggtggcgcgatttcgatttcgcgtcgttcgatgcgcggctcggcggcgaaccggcggccgacctgctgacgcacgatctgaagccggccgagatcaccgtctatacgcacggcgcggcatcgaaccgactgctgctccaggcccgcctgcgcccggacgaccgcggcgacgtcgaaatcgtcgaagcattctggccgcactcgcccgcgctcgattggcacgagccgcgcatgccgctcgtaccgccgctcctgatctatgcggatctcgtctcgtccggggacagccgcaaccttgccgccgccgaacggatccatgaccgatacctctcccatccgcccgcttgaaatcgacgcacgccggccgctcgacccggcggcggtcgcgctcttgcaagcggtgagccgtgcctgcgcgcgcgtcgatgcggccttcgtcgtcgccggcgcaaccgcgcgcgacatcctgatgtggcacgtccacggcatccggccggtgcgtgcgacacgggacgtcgacgtcgcggtgtgcgcggtgagctggccgtttcacgcgcagctcgtcgatacgctcgttgcgaccgggcaattcacgcgagcaccgaaacaacagcagaaactgctgttcgacagcggcacgcatggttttcgcaccgaactcgatctcgtgccgttcgggccgctcgaaacgccgccgggcgcgatcgcgtggccgccgggcggcgaattcgtgctgaacgtgctcggtttccaggaagcggtggacaccgcgcagccggtatcgatcgacgcgcgcaccgtcgtgccggtggccagcctgccggcgctcgcgctgctgaagctgctcgcctggaaggaccggcgtgcacgccagaacagcgatgcgtacgacctgctgttcctgctgcggaattttcacgatgcaggcaatcgcgagcgcatctgggacgccgcccccgacctgctggagctgcacgcgttccagcccggccttgccgccgccgcgctgctcgcgcgagacgcgaaacggattgcctcgccgcacacgcgcgacgcgatccgcgtgctgttgtccgacgaagcgacctatgccacgctcggccaggatctgctggcacgtgcgttcgcgctgttgccgggtgaattcagcgatgacgccaaccggtatctcgacgcattccgcgacgcctttctcgcggattcacccgcaccgcacgcatgacacgacgctgtggatgtgaagccgcgacgtcatcccgctttcgcactgccgcgctcaggccgcccagtcttcgagcgacaacccggccacccggccgaactcccggccgttgttcgtgacgagcaccgcaccggcggcgatcgcatgcccggcgatcgacgcatcgttcgcaccgatcggcgtgccgcgcgcggcgagatcggcgcaaatcgcggccgtcgcatcgacggccgccgtatcccacgacagcacgccatcgagccgcgagacaaaggccgtcacgagttccgcatgcttcggcgacgccttcctgccgactgcgccgaaccgcatttcggcataagtgatggccgacacgacgatccggtgctgcgcattgacgcacgattgcagccgcgacagcactaccggcggccgctcgcgcatgatgaacgaacagatgttcgtatcgagcatgtagagcgtggtcactggccggactccgtcggcgcggcgccgccggaaggtcgaagcggccggactcgatcacggccgggcgttcggcgaggaaatcggcgtcggccagcggttcgctcgcgaacgagagccacgtgggccgcaccggccgcagcatcagtgtgtcgccctcgcggcggatctcgagttccgtcacccctcgaactccatgtccttcgggatgcggattgcctggttacgggcgttcttgaaaatggaaacggtgcgcatgagccactccatgggagtacgatgcgcccattctagacatatgccagcatatgtcaaattgagaggacgcaaatcggacgtcgcgccccacgctgccacgggtgtttttgtcatgttgccggcctgtcgtcgatgaggagagcgatccattcttcacgacgcaggccacgcagtccatatcccgaacggccgatgccggtgcggcaccgcaccgcgcgcaacgtcgcaccgacgctgcgcacccgcgccgtcacggcaaccggaaagtgtcgaagaatgtgtctcgctcgatcacggtgagcgccgcgcgcttgtgcgggaagtcgaactccttcagcgtgtagaacccgagccggtgcatgtacgcgatgtgccgcacgtgatcgacgcgcggctcgccgacgagccgctgcgtgcgcggttcgtcgacgaacatgtagtgcagcaccccgctccaccatgcatgcagcttgccggcgctctggaaccgcgagtcgccgatcagcaggtgcagcccgcgatcgtagtcgtgcgcatcgtagaacggcgcgagacgatcctccttcgcccagtagaactcgaaatagccgaacggcgtgtcgtcgaaatagccgatcatcgggtgcatgtgcggatcggcgagccgctcggcaagatacgccgcgtgctcgtcgcgcgtgccgcgctggtcccagaaatgcgcgacgcgatcgaggttcatccagccgctgaacaggtccgcatgcgcgtcgatgtcgacggtgcgcaggctgaacgtcatcccgacctgcggcatatggcgtgcatagatctcgccggccggcgacggcggccgcaccgggtgccggtgcccgttcgtgattgcatggcgcagcggcatcccgcccgacgcgggcgccttcagccacggtcgcgggttctgccagaaggtcgtgcgcgatacggtgaaccgcagcgtgtcgccctcggcctgcgcgccgtcgatcacgccctcgcgcaccgcgcgcgccacgtacgacgcaacagccgccgcatcggcgccgccgagcggcaccgtgatcgtcgccgcgtcgtatcgcgtgtcggtgttgaagagcgcgacgaacgccgcgagcagtgcctccggcgaatcgtcgggccgccacgcgtcgagcgagcgctcggcgaccatcatcgccggcccgtgcgcggcgccgtcgagcgccgcggccacttcaccttcgacggcgtcggcggcgccggccggtttcgtcagcgtgtcttgcatcacagtgctcccgcgtcgtggcgatcggcgagaacgtgcagccccgctcgagcgccggaaacaggctgcgctggaagttgttccagcgcagttcgagaatcgtgtcgtccggtgcgatcggcgtgtcgagcacgtcgcagatcacctcgccggaatcgatgccgttgtcgacgtagtggaacgacgcgcccgtcatcatcacgggctcgacggacgacgtcgcgccgctcgcccagtcgacccgttcgccgcgcgcgccgtgcagcgcgtcgagcgtcgcccatgcgccgcgccgctggtacggcgaaccgtcggcggtgatgcccgggtggatgttggcgatgcgccggtgaaagcgcgcgccgggccgcacgagctcgtcgaggatcacgagcagcccgtcgagcacgacgacatcggcttcgagttcgagcaggcgctcgagcaggcggcgctcgaacgcctgtttgccggctgcacgctcgcgtgcgtcgcgcggcagccgccggtacgtcgacgcaatcgtgcagaacagttcgtcgaccggccggccctgcaccgtcaacccttccggcaggatccacgggcggcccggcgtgcgcgcgaaaccgtagtcggccaccttcgcgcggtcggccggcgaaccgtcgtcgtcgtcgacgatcacgcccttgagcgtgtagcgctcgccgagcggcgagtcgttcaggcgctcgacgaggaattcgagcggcgccttcatgtagcgcgtgccgccctgataagcgaccggctggccggcgcgatcggccgcgccgttgcgcagcgactggatgtagacgagattttcttcggcatggatgcgtcgtggaaaagcggacgaaggcgccgcggccggcccgcaccggccacgaaagccggccggcgggccgcggcgcgcatcgtcaccagttgtatttcgcggtcgcgatcaccgtgcggtcggtgccgaacacgcagacgttcaccgactggcagccgctgatgtagtggcggttggccaggttcgtcgcattcacggcgaagcgccagttgcgcgtgtcgtagtgcacgcccgcgtcgaacagcgtgacgctcgacaccgtcagcgcgttgtcggacccaccggccgacgcgctctggtagcgaacaccgccgccgaagcccagccccgcaagcgcccccgtatgccacgtccagtcggcccacagcgacgccatctggcgcggacgcggaatgtcgaccggccagttgttcagcgagttgtcgttcgccttgatgaccttcacgtcctggtagacgtacgaggcgatcagcgacaggttcggcgtgaccttgccggtcgcactcagctcgatcccgcgcgaacgcacctcgccggactgtaccgacttggtgccgctgtcgtcctggctcggcagcgccggcgtgatgccgttggtctggttgatctggtagatcgccgcgttcagcatcaggttcttgccgggcggctgccagcgcaggccggcctcgatctgcttgccgcgcgtcggctgcggcagcccgccgccgagcaggttcacaccgatcagcgggttgaacgaagtcgcgtagctgatgtacggcgacagcccgtagtcgccctggtacgtgaggccgacgcggccggtgaatgccgtcacgtccgccttcgtcgacgtgccgcccgcgcggtcgtccatccgcatgttgacccagtcctcgcggccgccgagcgtcagcgtccagcggttccacttgatctggtcctgcgcgtacaggccgaacgtgttcatcgccgtgtacgtgttggtgcgacccgtggtctccgggttggagaacaccgacgtggtcacgggcgtgtacaccgggttgtagatgttcaacggcggcgcggcggcaatccactcgctgtcggttgcggtctgccggttgtactggaagccgagcagcagcgtgtgctgcagcgggcccgtcgcgaagcggccctcgacgttgttgtcgatgtcgaagcggctgtagttcatctggaacacgccggcccagcggctgacatcggtcgtgctgccgtcgacgaagccgttgccccacaccgaaccgttgtcgagcgacaggtgcatcaggcggacgttctgccggaacgtccacgccgaagtcaggttctgctcgaactggtagccgaccgaccactgcttcttgcggtagtagttgaagttcgggtcgccttcgtacacgtccttgttgatctggccgttcgggttcggcagcaccgtgccctgcgcgggcaggaagttcgacgagatgtcgccccagtcctgcaggtacgtcgcggacagcgtcagcgacgtatccgcattcgggcgccagcggaacgacggcgcgagcgcgacgcgctggtcgttgttcgggccggtcagcgcattgccgtcgcgcgcgacgccgacgaaccggtacgcgtacttgccgtccgggtcgagcttgtcgcccacgtcgatcatgaactgcttgcgcgcgtagttgccgatctgcacgccggcctcgcgcacgcgctcgccgtcggcgagcttggtctgcacgtcgatgatcgcgccggggtcgcccgcgccgtacagcaccgaggtcggcccgcgcagcacggtgatgctgtcgatcatgtacggatcgacgcgccagctcgcgaggttgatcgtgttcggcacctgcagcccgttcacgtaggcggtcggcgtgaagccgcgcagtgccgcgtaccagtcggaacggttgtccgaaccgtacgacgagaaacccggcacgtagcgcagtgccgcgttcacgtcggtcgcgccggtcatctcgatctgctgcgcggtgacgacgttgatcgtctgcgggatctcgttgatcggtgtatcggtcttcgtgccggtccggctgcgcttcgcgacgagcccgaccgtgccgtccccttccgaggccgcgttgacgttgatcgtcggcagcgtaccggtcgacgcactggccgccgcaccgccctgcgcactgctggccgacgccgcggcgcctgcgttcacggccggcgccgtctgggcatatgcctgccccgccgccgcaccgaacgccacgcttgccgcggctgcgatcgcacgcaaacgcgtgcctgttgcccactccatctttctcagctccactttttcatgcggtctccgaccgcgcctttgtcaaagagcgaaagccatccggcccgcgctcaccccgttttcttgtcttgccttggccgcgccttcgtcatgggcgggcgcgatcccgtcttcgagcgacgcgcagatttcgtccgcgcggcgtgccagcaccgacagcagcgtgtcggacaatccatggctgtcttcgcagcagccttgcaggtagatgcgcggcgcgaagtgcgcgggcgtcgcgagcaggtagtcgcgcgtcacgtcgccacgctcgagcgcatcgcccaggtgcggcgcgagcccttcgagcagcgccgaatgggtgtcgcggcggtagccggtcgcgagcacgagcgcgtcgaagcgctcgacgcgcgtcgcccgctcatccggtcgcgcaacgtcagctcgatgcgaccgtcggcggtgcgcgccgcgccctcgatcgcgctgttcgcgagcagcgcatgacgcggcgtgccgtcgatgcgctgcaggtacagcatttcgtagatctgttcgatcagcggccggtcgaccaccgcgtagttcgtgtcgcgatagcgctcgagcagcgcgcggcgcgcgtcatgcggctgcgcatagacgacatcggtgaattcggggctgaagatctcgttgacgaacgggctgtcgtcggccggcagagcgcgcccgcgcgcatcacgaggctcgcgtcgacatgcgggaagcggcgcgcgagatcgatgaacacctcggccgcgctctgccccgcgccgatcaccgcgacgcggcggcgctcgccgtccggcgacgcgacgagccggtcgatgtcggtcaggtaggacgacgagtggatcacgcggtcgcggccgagcgcgacgaacgcgtccgggatcgccggcgtcccgccgacgccgaccgacagcgcgcgcgtgacgcgctggcgctcgtggccggcggcgtcgcgcgacaacacgcgcagcgcgtcgatccgcgcgccgtcgccgcgcacgggctcgatgcccagcacggtctcgctgtaatggacgcgatcatcgaacgcgtcggccacccagctcaggtagtcgtggaattcgacgcgggtcgggtagaagttcttcaggttgacgaattcgttcagccggccgcgttcgaacaggtagttgatgaacgtgtagcggcttttcggatcgcgcatcgtgacgagatccttcagaaacgagatctgcatccggcagtcgtcgagcagcatcccgcgatgccagccgaattcaggctggcgctcgacgaagcaatgggcgaacgtacgtgcgccgccgcgctccgcgaggcgcacggccagcgccagattcgacggcccgaagccgacgccgatcaggtcgaatacggtttctctctgcatgtctcagctcccttgtcggtgaatccggcccgtcagacgtgacggccggagaagaacgtctcgcgcagcgtgcgcatccacagcggctgcgcgtcggccagcgcgagacggcgctgccgcgcgaagccatgccgcgcgagatggtcggcaacccgcgcgtggccggccggaacggcacagccgaccgcttcggtacgcgggtcgtcgagaaacaggtaatgaacgacggacggcagccagcccgccacgcaatgcgggccgcgccagcgcgattcgccgaccagcatccgcagcccgcggtcgtagtcgcgcgccgcgacgtgcggcgcgagcgcgtcttccttcagccagaacgcctcgaaatacgcgaacggttcgccgtcgaagcagccgacgagcggtatgacgtgcgggtcggcatccggcgcggcaccctgcccgccgtccacgccaggctgcgcgcccggccagccgtcgcgcacgcgcggctcgtcgaaccagcgcgcgacgcgttgggcatcctcggccggctgccagccgcgcagcgtgaagcgcacgccgagcgccggcaggtcgcgcgcatagacttcgccgcgcggcgccggcggccggcgcgggtggcggcggccatcggtgaacaccggcagcgtcgcgcacggcagatgcgggccgacgagccacaggtcggcctgctgtgcccagccttcgcgcatgcaacagccggcgtcggcgagcacgccgctcgcgcgcagcgcatcgagcgcgaccgccggccacgcggccgggtcgagccggatcgacgcgtggcgcgcgctgtcggaaaacgccgcggccaatgcggccagcagcgcacgccgctggtcggccggcgacgcgcgatggttgtatgcgacgaggcgcagcgcgccgtcgtcgccgagttgcgcgcgcaacagctgcgcgccgatgccgtcgccctgcgcgacgcggatctccgcgccgtcgcgcacggcgaacaggccgtccgcgaacgcgaggcggtaggtatcgagcatcgtgaatccgtccggacgcacttcagccagcatggcgttcctcctgtcccgtttccgtgcatgtgtcgagccgcgcgccgagtgccgcgaacgtcggcgacgcgaacaggtcggcgaccgtcagcgcgtgaccggcccggctggccgcgtcgacgaagcgcacgacgtcgaacgacgtcgcgcccgcttcgaacaggtcggcatcgggctcgggcgcggccgtcgcgaacgtgtcggaccacagcgccgcgagcgcggcagccgcatgcggtgcgcgcgacgacgttgcggcgcgtgcgtcgcctgccgcgggcgcgcgcggcgacgcttgcgcagcggcatgcgtgtcgggcgcgccgagcgcggcttccgacgcgccggcgaagcgcgcgacttcgtcgtggtaaacgtcgacgagcgcatcgacgaagcggcggtcgagcagttcgtccgcatacgagaacgcggcgctcacgcgcccgtccggatgctcgacgacgtccagctccagcgtgaacacgacgcgatggcgtacctcgtcgaacccggccagcgacaggccggcccagtcgcgcgcggcggcaccggtcgggcgcaggtagttgaacatcacctggaacagcggattggcctgcgcggcacgcggcgcgcagcgccgcgacgacgtccgcgaacggcacgtcggcgtgcgcataggccgcgagtgccgtgtcgcgcacctgtgccagcacgtccgcgcgacgcgcggccgggtcgatccgcgtacgcacgacgaccgaattgatgaagaggccgagcgcctcgcgggccgcgtcgcccgtcagctcgcgcgtcgacgcgagcacgccgaccggctggtcggccgcacccgtcgcgcggaacaaggcggtgttgagcgccgcgtgcagcagcatcggcagcgtcgcgtgcgcggccgacgccgtatcgcgtgcggcgcggatcaacgcaccgtcgaattcgaacgcgatgcgcgccgcgcgccattgcggcacggccggcgcgttggcgcgctgcggcagcaggcgcgccggcaggccggccagcgcatcgcgccagtaagcaacgcgggccggatggcacggcgcgggcagcacgagcggccgggcgaccggctgggcgatctcccggccgccacggcaccgccctgcatgcgggcgacatagcgcgcgcgaaccgcatcgagccacagctcgatcgattcgccatccgacacgatgtgatgaatcgtcagcgacagcacgtgatcgtccgcgccgagccgcagcacccgcgcgcgccacagcggcgcatcggccgcgaggtcgaacggcgcgagcgcatcctcgtcggtcagcgccgccgcgcggcaagcacatcggcttgcgccgacaggtcgatcaccggcagttcgacggaaacgcctgtgtcgatccgctggcccggcagcgcgccgtcacgcgccacaagccgcgcgcgcagcgccggatgcacggccgcgacatccgagaaggccgcacgcagcgcatcgacgtcgagcgggccgcgcacccgcagcgcgaccggaatgttgtacgcggcgctgtccggctgcgcgcgccacaggaaccacaggccgagctgcgccggcgacagcggccacacgccgtgggcgtccggttgcgccaccgcaacgcccggcgccgcggcaccggcatgcgcggcgcgcggcgcatcgaccacctgacgcgcgtactgcgcgagcaccggcgcttcgaacagcgcgcgcaccggcacgtcgcggccgagccgttcggccacgcgcgtcgcgacgcgcacggcggcgagcgaatggccgccgagatcgaagaagtgatcgccccggcccacacgctcgagattcagcacgtcgcaccagatcgccgcgagcgcggcttcatcgccgtcctgcggcgcttcgtacgcgcgttcgacgcgcacgggcgccggcagccgtgcgcggtcgaccttgctgttcgcgttgcgcggcagcgcgtcgagcacgatcagttgcgcgggcaccatgtaatcgggcagcgtgcggcgcaggtgtgcgtcgagcgtcgcggcttcgaccggctgcgcggccgcctgggcgtcggcggtcagctcgacgtacgcgacgagctgcgcgagtgcgccctgcccgtgcacgaccgcgcatgcttcacgcaccgcgtcgtgtgcggcaagctgcgcctcgatctcgccgagttcgatgcgcagcccgcgcagcttcacctggtggtcgacgcggccgatgaagtcgaacacgccgtccgcgcgacgccgcacgaggtcgcccgtgcggtacagccgcgcacccggcgcgccgtacggatcaggcacgaaacgctcggccgtcagcgccgggcggtcgagatagccgcgcgcgacgccgatcccctcgccgcccagatacagttcgccgatcacgccgaccggcagcggatgcagccgctcgtcgagcacgtgcgcggtgcgtgcgccgaccagcgtaccgatcggcaggtacgcggcgtcgccgagtttcgcgagatcgtcgccgggccggaacatccatagcgtcggcgtgatgaccgtctcggtcggcccgtagccgttgaccacgcgcacgttcggcagcgcgcggcgcagcatcgcgaacgcctcgcgcgacgtcgcttcgccgccgacggtcagcgaccgcagtgtcggcggcgcgccgtgcgcgagcgcccattcggcgagctgcgcggcgcagccgggcggcacgtaggtcatcgtcacgccgtcgcggaccatcatcgcgcaggtctgcgcgggcggccaacacatcagccgtcaccgacacggcggcgcccgacatgtattgcgagaaccagccttcatgcgcgccgtcgaagttgaccgactggaacagcaggaacacgtcctgctcgcccgcgccgtagcgctcggcgatcgccgcgcaatgcagcgcgaacgatgcatggtcgacgatcacgcccttcggcttgccggtcgagcccgacgtgtagatcgcataagccgcatgccccggcagcacgtccggcagcacgacgtgcgccgcttcgtcgagtgcagcgacttcatcggcgcgccacacgcgcagcgccggcagctcgggcagcgacgcggcgctcgcgccgtcggtcagcacgtgcgcgatgttcgcgtcgccgacgatctgcgtgagccgttcgcgcggatgagccggatcgagcggcacgaacgcggcgcccgacttcaataccgcgatcagcgcgacgagcaggtcgaccgagcgctgcagcgcgacgccgactcgcatttccggccgtacgccggccgccaccagatggcgcgccaggcgggccgcgcgcgcatcgacttcgccgcgcgtgaacgcacgatcgatatcggcgacgccgcgcgcgtcgggccgtgcctgcgcatgcgcggcgatgcgtgcatgcacgggcacgaacggctcggcatcggtcgcgccggccggcgcgttccatgcaggagctgcgcgcgctcggcggcgggcagccagtcgagatcgccgaccggcatgtcggggcgcgcgagcgcatcggcgagcagcgtgacgaagcgcgcggccagccgttcgatcgcatccgcatcgaacaggtcgagcgcgtagatgaacgcggcgtcgaacgtgccgtccggcgtcgcttcgaccgacagcgtcaagtcgaatttcgcggaaggcgtaccggacggcagcaacgcggccgacgccgcgccgagcgccggcaacgcgcgacgctcgccgtacgcggccatcacctggaacagcggatggtggctcgcgctgcgcggcacgccgagcgcgtcgaccacctgctcgaacggcacgtcctgatgcatctgcgcgtcgacgagcgcacgctgcgtgcgcgcgaccagcgacgagaaatcgccgtgcgcgggcacgtcgacgtcgatcgccagcgtgttgacgaagaagccgatcaggccggcgacttccgcgcgttcgcggttcgcggccggcacgccgacgcagatccgcgcatcgcccgtcgcgcgcgcgagcagcgcatcgagcgcggcgagcagcaccgcgaacggcgtggcgcccgatgcggccgcgaacgcgcgcagttgcgcgccgatgcgcgcgtcaagcgaaaacacgtggcgagcgccgcgcgcactgcggcgcgcgggtcgtgcggccgcgcccggcagcgtcagcacaccgcgctgcggatcgagccgttcgcgccagaacgcgagctggcgttcgcgctcgccggcgtcgagccagcggcgctgccacagcgcgtagtcggcgtactggatcggcagcggcgcgagcggcaccggccggtcggacgcatacgtgcgatagaacgccgcgagttcctcgagcatcacgcccgacgaccagccgtccgacacgatgtggtgcacggtcagcgcgagccagtgatgcgtcgcgtcgaagcgcaccaggtgggcgcgcacgagcggcgccacgccgagatcgaacggttcggcttcctcggccgtcgcgacggcttgcgcgcgcgccgtgcgctgcgcgtccggcagcgcttcgagaccggtttcgcgccacgggcagcgcatcggcgcgtggatcgtttgcgcgacgccgtcctgcgcttcgtcgaaggtcgtgcgcagcgcctcgtggcgcgcgatcagcgcgtcgcatgccaggcgcaacgcgtgcgcgtcgagcgggcccgtcagcgccaggcgctcggtgatgtggtacgcgtccggcgcatcgatcagccgcgcatgcagccacagccgcgtctgtgcgaacgacgccggcacgcggtcgctgcgcggcgtgcgcggcgggatcggcagcacgcgaaaatcgatgccggccgcgccgagcttgtcgatgaacaccgcgcgctgcgcgtcgggcagttgcgcgaaacgcgtcgcgagcgccagccagtcgggttgaaccttcgtcatccgtcgtccttattgggtttccagttcgccgagcagcgcgtcgatcgcgctcgccgcatcggtcgcgccgcgtgccgcgcaggccgcatcgatcgcttccgcgcaacgcgccagcgtgcgcgtgtcgaacagcgtgcgcagcggcaacgcgagccccagtgcaggttcgcctgcgcatgggcctgcgtcgcgagcagcgaatggccgccgagcaggaagaagtcgccgtcgcggcagatcgcgtccacgtgcagcacgcgttgccagatcccggcgagcgcgcgttccgtgtcggtcgcgagtgccgcttcggccgccgtctcgcgtaccggcgcgggcagcgcatggcggtcgcacttgccgttcggcgtgacgggcaacgcgtcgagttcgaccagctgcgacggcaccatgtaggccggcagttgcgcgcgcagcgagtcgagcagcgccgcccggtcgagcggggccgcatcgccgcgtgcgacataaccgaccagttgctcgtcgcgcacgatcacgaccgcatcgttcacgccaggcaccgcgcgcagcagcgcctcgatctcgcccggctcgatccgctggccgcgcagcttgacctgcgtatcgacgcggccgaggtagtcgagcgcaccgtccgcccgccgtcgcgcgaggtcgcccgtgcggtacatgcgcgcgcccggtacgaacggatcgggcacgaagcgctcggcggtcagcgccggacggccgagataaccgcgcgcgaggcccgcgcccgcgagatacagttcgccggtcgcgccggccggcaccggctgccatgcggcatcgagcacgtgcaattgcaggttcgcgatcggatggccgatcggcaccgcgaccgcctgcgcgtcgtcggggccgcacgtccagtgcgacacgtcgatcgcggcctcggtcggcccgtacaggttgacgagcgtcgcgtgcggcagcagccgcgccattttctcgacgagttcgggcgcgagcgcctcgccgctcgcgacgatcaggcgcacgctgtcgcattgcgcggcggccgcgaaatcgtcgagatgcgcggcgaacgcggcgagcatcgacggcacgaagtgcagcaccgtcacgccgtgcgcatggatcgcggccgcgagacgcgccggatcgcgatggtcgccgggcgcggcgatcgcgagcttcgcgccgatcgccagcggccacacgaattcccacaccgacacgtcgaagccgaacggcgtcttgtgcagcacgacgtcgtcgcgcgtcagccggtacgcgtgctgcatccacgcgatccggttcgcgagcgcgccgtgcgtgttgccggcgcccttcggcttgccggtcgagccggacgtgtagatcaggtaggcaagctgtgcgtcgtcgacctcggcggtcacgccggcggtgtcgtcgaccgtttcgtcgaccgtttcgtcgacggtttcgtcggccagcaggtccgcgaccgtcagcagctgcgtcgttgcaccgtcgcccagcgccgcctcgacctgctcgcgcagatgggcctgggtgatcgcgacggccggccgcgcgtcgcgcaacagatacgcgatgcgttcggccggatagtcgggatcgaccggcaggtaggccgcgccggccttcagcacgccgaccagcgccatcaccatgtcgaacgaacgctcgacgcacagcgcgaccggcgtatcgggccgcacgccgcgccggcgcagcgcggccgcgatgcgcgacgtaccgacgtcgagctcgcgataggtcgcgcgatgcacgccgccgtgaacgtccgcgtattcgagcgcgatcgcgtcgggcgtcgcccgcgccgcatcggcgaattgcaggtgcagcggctgccgttgcgaagccggccatgtgcgcgcggtgtcctgcgcccgcgccagtgcgtcgcgggtggcgtcgtcggcgatcgacagtgtgccgagcagcgcatccggcgtgcgggccagcgcatcgagtgcgcaggcgaacgcgcggtgccaggtttcgacctgccgcgcatcgacgcgcgcggtgtcgtagccgtagtcgatcgtcagctcggcgccgctctcgatcacgagcgtcagcgcgaaatcggtggcttcgatgctgcgcacgccgttcaaaaccagcgcgcgcggatcggcatcgcgcgccgtgtcgtcgaccggatagttctcgaacacgaccagcgtgtcgaacagtgcgccgcccgcgccgcgcgcccagcgctggatgtcggcaagcggcgtatgcgcgtgctcggcggccgccgcgttgtcgcgttgcagggcttgcagccagtcggccgcgcgttgctgcggcgccggcgcggtgatcaccggcaccgtgttgatgaagaggccgagcaccgaatcgacgtccgcgagtgcgtcgggacggcccgcgacggtcgcgccgaacgcgacggccggctggtgcgtcatccgttgcagcgcgagcgcccatgcaccctgcaccagcgtgttgacggtcagcttcagcgcgcgtgccgtctgcgcgacacgcgtcatcgcgtcggcatcgagcgtcgcgcgccacgtgaccatgtcggcatccgcacggtcggccgtgcggtcggcgatcagcgtcggggcgtcgagtcgtgcgaggcgttcggtccagaagcgttcgtcggcgtcgcggtcgcgcgtgccgagccaggcgatgaagtcgcgataccggagtgccgggcggctcgcgaacggcgatacggcgtccgggtcgcgatagtcgcgcagcacgtccgccagcaggcgcgcggtgctccagccgtcgagcagcacgtggtgacgcgtccacacgacgcgccatgcgtcgtcggtcacgcggatcagcgtgaggcgcatcaacggcggctcgcgccagtcgaagccgcgtgcgcgatcggccgcgagccatgcgtcgaaatcggcgtcgagcgtgtcgccgcgcgtgcgccagtcgagctgttcgaccggcatccgggcgtggcgatgcacgcactgcagcggcgcggcttcgtccggcatcacgctcgtgcgcaggatgtcgtggcgcgcgatggacgcttcgaacgcggcgacgagccggtcggcatcgagcgcggccgcggtcgcgacgagctggttcacgtagctggcgtgaccgggtgcgaacagcgcatggaacaggatgccctgctgcatcggcgacagcggatagacgtcgtcgatcgtgcgccagtcgagcggcgtgcgttcgatcgcggcctgcgtgagaccggcggcctgcgcaagcggaaatcgcccggcgtcgcgccggcgccgcgatgcgcgacgcgtgacgcacacgcgtcgacgagctcgcgcagcgccgccgcgaagcgttcggcacatgcgtcgatcgtcgtgcgctcgaattgcggtgcaccgtagacccagtgcactttcagcgtgcgtgcgccgtcgcgatccgtatcgaggtacgcgtggatcgcgagcgcattgccgagcggaccttgcggatcgcgctcgacgccggtgccgccgaagcgcggcacgagcgtggcatcgcgcggggcgtcgaactggccgagatagttgaacgtgacgcgcggacgcggcacggcggcgagcaccgcgcgcgtcgccgcatcgccgtagtgcgcgagcacgccgaagccgagccccttgtgcggcacggcgcgcaacgtgtccttgaccgcgcacagcgtgtcgcgcgcggtggccgcgaccggcagcgtcaccgggtaatggctcgtcagccagccgatcgtgcggctcgcatcggcatcgtcgaacagcgcctcgcggccatgtccttccagttcgatacggcacgaggcggcgccgctggcgccggccagcgccattgcgagcgcggcaccgagcaattcgatcgtctgcgtgcgataggcggcatgcgcatcggtcagcgccgcgcgggtcaatgccgcgtcgatcgtctgcacgacgacggctgcatcggcgttcgttgccgtggcgtcggggtggtcgggcacaacgtcgtcaccctgcgccatgccggcccagtacgccgcctcggccgcgaacggcgaagccggttccgtcgccgcacgggccagccgcgacgcccaggcatccgcgcgcaggcccggctgcgacagccggatgggcgtgcgctcgcatgccgcgcggtaggccgagtccaggtcgtcgagcaggatgcgccacgacacgccgtcgacgatcgcatggtgaatcgtcagatagagctgcgtcgagccgtccggcaagcgtgccgcgcatgcgcaggccagcggcccgcgaccgaggtcgaggcggcgctgcaacgcgtcgaagcgcgcgagcgcgtcggcttcgtcgcgggcggcgacttcgacgaacggcagcgcgtcgtacggtttcgcggcatcgctggcgtgccacgtgccgtccgcgccgcgtgcgaaacgctggcggaatgcgtcgtgatgcgtcagcaatgcgtcgaaggcgcgcgcgaacgcatcggcgtcgaacggcccgcgcacgtcgaatgcgaccgactggttccagtggcctgggcgcgggatgtcgagcgcgaagaagcgctgctgcgcgggcgtcaggacctgcgccgtcaccggtgcgccggcggcagatccgaccgcaggctgcgcgacggcggcggcggcagccacgtcctcggtcttcgcgatgcgtgcgagttcggcgaccgtcgggctgtcgaacagctgcttcggcgtgaagcgcacgccgcgcttgcgcgcacgggcgatcacctgcagcacgaggatcgaatcgccgccgagttcgaagaagttgtcgtcgcggccgacctgcggcgccttcagcacggcctgccagacttcggcgagcatcgtttcgaccgcgccctgcggcgcattcccgggcgccgtcgcgaccggcgcggccgcctgttcacgcaacgcggcacgatcgatcttgccgttcgcggtcacgggaaggcgtgcgagcgcgacgaactgcgcgggcaccatgtagtcgggcagcttcgcggcaagcgccgcgcgcacggcagcctcgtcgaaggtcgcgccgtcgcgcatcacgacgaacgtcgcgagccgcaggcggccatcgtgttcgatcgcgagcgtttcggcctgcgcgaccggcccggccgcacgcacggccgcactcacctcgcccggttcgacacggtagccccgaatcttcacctggtcgtcgatgcggccgaggaacgcgagacggccgtcggcgcgcaaccggacacggtcgcccgtgcgatacagccgcgcaccgggcgtaaacggatcgggcacgaagcgctcggcggtctgcgccgggcgccccaggtagccgcgcgcgacgcccggcccgcccagatacagctcgcccgtcgcgccggccggcacgcacgcgctgaacgcgtcgagcaccagcgcgcgcgcattcggcagcggcaggccgagcggcacgccgctcgcgggatcgcgcgcatcggcggcgatcgacgccgtatcgcacgcgatcgcaccgaccgtcgcttccgtcggcccgtagtggttgatcacgcgacaggccggcgcaagcgcggccaggcgcgcgacgagcgcccacgtcagcgtttcgccgccggtcacgagcgcatggcgcggcagcacgtcggccggcacgcgtgcgtcgagcagcgcctgcaggtggctcggcacgatcttcagcacgccgacgtcacggcggcgcatctcgtcggcgaacaggtccggatcgaacgcgcacgcggccggcagcaggtgcagcgtgcggcccgcgcacagcgcgccgaacagcgtcgtatgaccgaggtcggccgcgacggtcgataccatcgcgaacgatgcgtccggtgcgaacgcgagttcgtcgagcatcccctgcacgtagtcggccagcgcgccgtgcgacacgacgacgcccttcggcgtgccggtcgagcccgacgtatagatcaggtaagcgccctgttccgggtgcggcgcgacgcgcacgccggccgcgagcgttgcgtcctgcgcgagcgtgtcgacgtcgagcggctgtgcgtcgatgccggccggccacgccgcggtatccgcgacgagcgcccagcgcgcgccgcagtcggctgccgccgcggccagccgggcggccggctgcgcgggatcgagcagcacggcgagcgcgccggccttcagcgcgccgagcaggccgacgacgaagcgcgcggagcgttcgatgcagacgatcaccggcgcttcggcgcccacgcctcgcccggacagcgcgcgtgcgaggcggttcgatgcgtcgtcgagttcgccgaacgtcagcgacgccgacgcatcggcaagcgcgacgcgatgcggatacgcggccgcctgccgcgcgaacgcggcgacgatgtcggcatgttcgatgcgcagcgcacggccgtcgcgcggctggcgcgcagcggccgacgcgtcgcacggcaggacggccgtcgtttggtgcggatcgcgcgcggcggcaccgacgagcgccgcgtagctgtggagccacgcgcgcgcggtgtccgcatcgatgcagtcggtcgcataggccgcgaccagttcgatgccgttcgcatcgtcggtgaaatccaccgcgtagtcgaagcgtgcggcgagatcggggcccggcgtcgcgacggccgtcgcgcccggcagcacgctgtcgtgccgcgcgtcgaactgctgcgcgaatttcacgcgcagccattcgtcgccgcgcttgaccggcggcttcaccgcatcgacgacacgctcgaacggcacgtcctggtgggcaaccgcgtcgagcgccgccgtgcgcgccgcgtcgacgagcgcgcggaacggcagcgtcggcgtcacccgcacgcgcagcgcgaccgtattcaggaacaggcccagcagcgcacgcgtttcggggcgctgacgatgcgcgaccggtaccgcgaccacgacatccgttgcgccggtcaggcgcgacagccaagcgtcgagcgcggccagcagcaccgtgaagacggtcgcctgcgcgtcgcgcgcgagttgccgcacgtcggccgcgaccgcgtcgggcagccgcaccgacacgcgcgcaccttgcagcgtgcgcgccgcgcccggctggcggtcgaccggcagcgcgagcgggcccggcacgtcacgcaatgcgccgcgccagtaatcgagctgacgttcaccctcgccgccggccagcatgtcgcgttgccagtccgcatagtcggcgtactggatcggcagatcgggcagcgacggcgcgcggccttcggcatacgcgcgataggcggccgacagttcgtcgaacgcgcagcgcgagctccagccgtcggtgatcgcgtgatgggcggtcagcagcaggcggtgacggtcgcccgcgagcgcgaccagcgtcgcgcgcagcagcgggccgcgcgcgaggtcgaacggttcggccgcttcgcgctcggcaagacgcgcggcttgcgcgtcgcgggcggcgggcggctggtcgcgcaggtcgacgtcggcgatcgacaccggcaggtgcgcatgaatccgctgcatcaccacgccgtcgtcgttgtcgacgagcgtcgtgcgccatgcctcgtgccggccgatcacgtgatcgagcgcgcgttgcagcgcgtcgcgatcgagcgtgccgtcgatcgtccagtgcgcggcgatgtgatatgcggcgctcgcgtcacgcgtttgcgcgagcacccagaaacgttgctgcgcgagcgaggcggcacgatcgacgtacggcgcgcatgccgcggcagcatcggccgcatccgtcgtcaaacggcgcgcggcgatcgcggccagcggttcgccggtttcgcgttccgcacgatcgaccgcttcggccagttccgcgagcgccggatcggcgaacagcgtatcgagccgcaggttcacgcgtaccgcggcacggatcgcggcctgcaactgcatcgccgcgagcgaatcggcgcccagcgcgaaaaagcggtcgtcgcgcgacggtgcggcatcgaggccgagcagcgcctgccagaggccggcgagctgctgttcggtcggcgtgcgcggtgcgtcgccgccaccctgcgtcgtgtcgcgcgcggcggcaatcttctcgcgcagcgcggcacggtcgatcttgccgttcaacgtgtacggcagcgcgtcgcaacgcacgaaccggtgcggctgccatgcggccggcagttgctcggccacgtgcgccttgagcgccgcatcgtcggccgccgcgcgcagtgcgacgcacgcgatcaggcgcgtcggcccgttgccggtttcggcgaccacggccgcgtcggccacggccggatgcgagcgcaggcacgcggcgatttcggccggctccacgcgcacgccgcgtacctggacctggtcgtcgaggcggccgagatagtcgaatgcgccgtcgtcgcgcagccgtgcgaggtcgccggtacggtacacgcgcgcaccgggttcgccgtcggcatccggaatgaaacgttcggccgtcagcgccgggcggccgtgatagccgcgcgcgacgcagacgccgcccagcagcaattcgcccacgccgtcgccctcgccaccgtcaacgcgcgcgacgcgcgggccgatcacgcgaccgatcggcaacgacgcatacgcatcgtcggcggccagcacgggcgtctcgcccggttcgaccggccacagcatcggcgaaatcacggcctcggtcggcccgtaaccgttgatcaggcgtaccgacgggaaggtgcggcgcacgaattcgaacgcctgctgcggcagcgcttcgccgccgaacgcgagcacgcgtagcgccggcggcacgccgtcgcgcgcggccaccgcggcgaattcgcgcaggtacgcaggcgggaacgccgccacgttgaccgcttcgctcaccatcagcgcatgcgcggcatccggcgcgaacggctgcggcggtgcgacgacgatgctcgcgccggtcgcgagcggcgcgagccagcactcgtgcgcggcgtcgaaattgaccgacgcgaaatgcagcaggcggtcgccggcctcgatcggcagcgcggccgcgagcgcgtcgcagtgcgcggcgagcggcccgtgctcgacgacgaccgccttcggcgtgccggtcgaacccgacgtgtagatcatgtaggcggccgcacgcgggtggacgggcaccgcctcgtcatcctcggcgacctcccggccgtccgccgcatcggctgccgcgtcgaacgcgtgctcgaacggcgcgccgagcgccgcgcggccggccgcgtcgacgatgccgtgccgcagctgggcatcccggacgatccagtcgaggcgcgcggccggatggcgcgggtcgagcggcacgaacacgccgcccgccttcagcacggccagcagcgcgacgaacagttcgcacgaacgctcgacgcacacgcccacccgcacttccgcgccgacaccggccgcgcgcagttgccgggccagccgcgacgcccgcgcgtcgagcgcgccgcgcgacaggcgcaagccgttctggaaaggtgccgcgattgcaggtgcgtcgggcgcgatgcgcgccagttcgcggattaggtgatgcagcgcagtcgggaaactcgtcatgtgcgtgaagtccttcggtccggccgcttcggccaagtctcggggccgcttggggcggcttcactggtgtgacgaacggcgcggccgatttttaccgttttgtgcgcaaagtgcgggcggacgcttttttgaacgcgcggctaaatatttgcgcggcccgttcgtctatcagggaggaaagccgcaacggggccccgcctcgtccgccgctttcgcgccagctttgccgttctggcgttttcgcctgccttccctttaccgacgttgccgatgaccgctgcccacgagccttcttccccgccgtccctcgacgcctccccgcccgccccgcggcgcggctgatcctcgcgctgctgcgcgaaagccgcgcgtcgctcgcgctggcgctcaccgcgtgcgtgctgaacggcgtcgcgagcgtgctgctcgtcgcgacgctgaaccgcgcgctgtcgcagccgggcgcggccgacgcgtcgctcgcatggcgcttcgcgctgtgcgcggtgatcgcgctcgtcacccggatcgtgtcgggcacgctgttcgcgcgcctgtcgcaggacacgatggcgcggctgcgcgtgcatctcgcgcggcgcgtcggcgcggccgagctgcgcaacatcgagcggatcggcgcggcgcccgtgcagtcggtgctgaccgacgacgcgaccaacgtgtcgatgctgttcttcgcgctgccgaacctcgtcatgcacggctcgatcgtgttcggctgcctcggttatctcgcgtggctgtcgtggccggtgtgcctgctggcgctggccgcgatcgtcgccggctcgctcggctatcacaccggcgaccgccgcgcgatcgcgtcgctcgaagcggccggccaggcgcaggaccgcctgttcggctatctcggctcgctgttttccggcgcgaaggagctgaagctgcacgatgaacgcgcaagacagttcgtcgacggccagctcggcgccgcgatcggcgaagtgcgcgaccaccgccgccgcgcgttcagcgcgtacgcggtcggcgtcggctggatcatcttcctgttctatgcgttcctcggcgtcgcgtcgttctggccgcagctcggcgtgcatgccgatccggccgcggccgccggctacgtcgtcgtgttcctgttcatgctcgtgccgctcgacgggctgctgaacaacctgccgaccgtcaacgcggcacgcgtgtcgctgacgcggatcgaaggcgtgatggccgaattcggcgcgctgcgcacggtgccgcccgccgccaacgcacccgacgtgccgccggccggtgccgtcacgctgcgcggcgtcacgcatgcgtacttccacgaacgcgacgaacggatgttcagcgtcgggccgatcgacctgacgatcaggccgggcgagctcgtgttcatcgtcggcggcaacggcagcggcaagacgacgctcgcgaaggtgctgacggggctttacgaaccggaggaaggcacgatcgaggtcgacggccgcccgatcggctggcgcgagcgcgccgcctatcggcagcgcttcagcgcggtgttcaacgatttccacctgttcgatgcgctgctcggcatcgtcgatcccgacgatccgtcccgcgcgcaggccgatgcgcgcgcgaacgcgctcgtcgcgaagctcgcgctcgatcacaaggtgaaggtggtcgacggcgcgttctcgacccgcgcgctgtcgaccgggcagcgcaagcggctcgccctcgtcgtcgcgtacctggaggaccggccgttctacctgttcgacgaatgggcggccgaccaggatccgtcgttcaaggccgtgttctacgaacaactgctgcccgagctgcgcgcgcgcggcaaggccgtgatcgtgatcacgcacgacgaccgctacttcgatctcgccgaccgtttgttgaagctcgacaacggacgtatcgtcagcgacacgatgcccgcgcggtcacgcgcgcaggacggcgtcgacgcgctgagtgcgtaatccggccgtcgatgaaaaatcgccggtgggctgcaatggcagcgcaccggcgatattcgtttcagaaggaaatgttggtggcgcgcggcgcgatcgtcgcaatgccccggccgtccagcgcgagtcgggtctaccgccacaccctgcccgcccgggcggcaatcgaccgccgcacactcaacgcacggccggcagcttcagcatcgtgtcggtcatcacgtcggccagtttcagcgccgacatcggcccgccgaaccccagatattgcgttcgatcagcgcgatccggcgttccttcatcgcgggaacgaaacgccacaccggcgaatcgagtttcgcggacagcggcacgtccatgcccgatgcggtcacgaacagcacggccagctcgcgctgcctgagcagatcggccgacgtcacgtacagcgtgccttcccgcgtcggtttcttcggccacggatcgagcccgagcgcccgcgcgaggcccgccgacgtgctgttgcccgtataggcccagtagcggtcgggcaagccgagatcctgcaacagcgcgatgcgctcgcctttcctgcccgcggccgcgagccgcgccgcattgcgcgcgatgcccgcatcgagttgcgcatcgaccgcctgcgcgcgcgcgtcgcgcccgtgaccgcaccgatcgtccggaagatctgccgcatccagtcgagctgcgttaccggcacgccgccatccgacacgttcgggctgaactggaacaggatcgtcggcgcgatccggtcgagcgcatcgaaaatcggcgcatgacggaagccgacgccgatgatcaggtcgggcttgaccgccgcaatcgcctcgaggcccggctcctggcgcgaaccgatgtcggtcacgctggcgagccggtcgctttgataaccgagccagcccggatagaacgccgtatcggccatcccgaccggcacgatgtcgagcgcgatcacgctttccgcgaacatgaaatcgagcgcgaccacgcgctgcggccgcaccggcatcgtcgcgctcgcctgcgacacgacgggattgccggccagcgataccgcgcccggtgcgccctgcacgcgatgtgcatcgagggccgcggcaacggcgccggacgaggccgacagcgcgccgcaacacgcggcgccgagcgccgcgattgcgccgatcgcgccgagtgcgtgccggcggccggcatccgtcaccggatcgcgtcctgctcggccagcgccgcgtcgtccatcgtcagtagcagggggcagcttccacacagttgcgtttctccaggaatttcatagcgcaggcagcacacgcgtcgcgcgcggaacggcgtgggcagcagcgccgaacgcggcaccgcgtcgcgcacaggcatgcgcaacggattcggttcgcacgcaaagcacgtcgcaccgaacagccagcccgcgtcgcgcaccggatcggccgcgcatggcagcgcacgatacgtatcgagcagatagtcgagcaggttgcccgcgttgctccacagcacgcgcggcgtgacgcgccccatcgccgtgagcaggtcgatcaccgcgccgagatgcgcgacgagccccgcgtagcgtggcgccgggtcgtcgcagggttcgccgagcgcatcgtgcgtgaaatacagcgcggcgggcatcccgtcgtcgagcgcgacgaacgtgcgctcgggtgtcatgtcgagcggccggccgagcgtcagcgcggcgacgacgccggccggcgccgcgcggccgaaatagtatttgctccattgcgacatcagcgcgcgcgcgtgctgcgccggatcgccgccgtaatggcggaccatcgcgtcgagcacgacgtcgcggtacgcgggcaacgcgctgaccggcacgacgaggcggcccggcgcgtgcgcgtcgtcgggcaaaccgagccagacgacgtcgagatgatcggcgaacggttcgggcgcgaacgccgagaaacgcgtggcgcgcgcgccgtcgagcggcagcgtcatcgccccgcgcgccgggcgcggcgccctcgaggatcaggagcccgagcaggtacggcgcgccgatcagcgcggtcagcacgccggccggcacttcgcgcggcgcgacgaccgtgcgcgccgcgaggtccgccacaccgaggatcagcgcgccgcacgcggccgcgagccacagccgcgtacggtgccggcgcgcgccgagcatcgtcgcgacgtgcggcgccatcaacccgatgaagccgaccggcccgaccgccgcgacggccgcacaggcggcgagcgtcgcgatcgtcagcgcgagcggccgcagcacggccaccggcaggccgagcgcggccgcctggtcgtcgccgagcgcgagcatgtcgagcggtttcgcgagccacgcgaacacgggcaccgcgagcacgcaccacggcagcagcatcgacacctcgccccagctgcggccgtaagtcccgccgacgagccacacgacgaagcgcgcgggctgcacgctttcctgcgtgatcagccattgcgcgagcgtggtccacaacgcgccgatcacgatgcccgtcagcgccaccgcgagcggcgcatagcgatgccggtgattcagcgcgagcgtgatcgcgagcgacagcccgccgccgatcagcgcggccgccgcgagcgtcacgtggcccatcagcggccacgtcgacaacgcgaacagcgtgacgagccccgcaccctgcgtgacgccgagcacttcggggcccgcgagcggattgcgcacgacgctttgcatcgcgaccccgctcactgcgagcagcgcgcccgcgaggagcgcgcacagcagccgcggcatgcgcaggtcgatcagcatccgcgcgagcgcatcgtggccggacagcgcagcggaccagcgcgcgatcgacagccactcggggccggccgacacgccgacgaacacggccagcacgcccgccgcgacgaacagcgccgtgcgcagcggccagccgagccgttcgagccagccgacgagccgcgtcgagccgccgcccgccgcgcgttcggcatccgcatgcagcacgcccgaccacgcggcgccgcgccggatcatcgccagcatcagcggcgtgccgaccagcgcgatcgcgacgccggtcgacagcgtggcgtcgagccccgacgcgagcaccgcgctgtcggtgacgagcacgagcgcaccgcccgcgagcgccgacagcggcacgagcacgccgagccgcgcggcgcgcgcgccgcgcacctggcgcagcaggttcggggcgacgaggccgacatacgacagcgggcccgcgatactgacggccacgctcgtgaacgcgaccgcgacgatcgtcgcggcgagccgcgtcgcgtcgacgcgcacgccggccgcggccgccgcgtcgtcgccgagcgtgagcggattcagcggccggatcacgaacggcaatgcgatcagcggcacgacgagccagcgcgcggcgagcgcgaggcccgtcgcgcccggctggtacaggctgccgttggtccacagcgcggcgcccgcgatgttctgctcgaagaaggcgagcacgagcgtcgacagcgcggcgaacagcagcatgcacacgctgcccgcgagcacgagacgcaacggcgtcgcgcgccagccgccggccgcgacgatcgcgcaggcggccgcggccagcccgcacacgaacagcagcggcaccgatgcgacgccggccagcgccggcacgagcatcgccgcgagcaggccgagctgggcgccgcccgtcacgccgagcaaatcaggcgacgcgagcggattgcgcgtgagcgactggaacagcgcgcccgcgatgccgaggcacccgcccgcgacgagcgcggccgcgacgcgcggcaggttgaggtcgaacaggaacacgtgcgcaagcgcagcggcatcgctgccgggcaccgcgctccaccacacgcgcagatcgggggcgacgcgcaacgccgccagcgccgcgatcagcgcgacgaggccgatcgcgatcgcaccggcccggcccgatgtcgtgccctcccgccgccgcgaggcgcttgcgcatcgcgaacgtggtcatacggcgagatcccggtcgaagacaccggccgcctgcggcgcgccgtcggttgtcggcccgtaggccggcacgcacatcggtgcgcccgtctgcggatgcgcgagcttcagcatctcgacgccgaacgccgcgcgcagccgcgccggatcgagcatcgcgtcgggcgtgccctgagcgacgaggcggcccgcgcgcatcagcacgatttcgtcgctgtatgcggccgcctggttcaggtcgtgcagcacccagacgatcgtcagcccgcgcgtgcggttcagcgtgcgcagcgcatcgaggatgtcgagctggtgatggatgtcgagataggtcgtcggttcgtccagcagcacgatcggcgcctgctgggcgagcgccatcgcgatccacgcacgctggcgctcgccgcccgacagtgcgccgacgtcgcgctccgcatcgccggcgaggccgctcgtgtcgagcgcctcgtcgatcgccgcatggtcggcccgcgacaggccgcgcaggaagccgccgtacgcatagcgcccgtacgcgacgagttcgcgcaccgtcaggcccgacggaatctggttgaactgcgcgagcatcgtcagctcgcgcgcgagcgcgcgacggcgaaacgacgcgagcggctgcccgttcacttcgacatggccggcacgcgcgggctgcaagcccgcgagcgtgcgcagcagcgtgctcttgccgcagccgttcggtccgcacagcgcggttacgcggccggccgcgatcgacaggtccagcccgtcgatcacgacatggtcgcgatatcccaccgacagcccgcgcgcggcaagcgcgcggtactacgcgtcatcaatcctccgttcggtcgcgcgggaccgtataactctgcgccatcgcgacgacgaccttgcgcggcccctcgaacgggtcgcgcgcatgcgcggtcagcatgttgtcgagcatcagcacgtcacctgtgcgccacgggaacacgatgcgctgctggtcgagcacgccgcggatctccgcgagcgcgtcggcttcgagcggttcgccgtcgccgtaatacacgttgcgcggcacgttctcgagcccaaccgcgtcgacgagcgcttcctgcatgtcgtcgtcgagcgccgacaggtgaaacaggttcgcctggttgaaccacacgcggtcgccggtgcgcggatggcgcgcgacggcctggcagcgttcacgcgtgcgcagcagcagctcgccgtcatcatcggtgcgccacgcgcattcgatgccgcgcgccgcgcacatccgttcgacctcggccggttcgtcggtgccgaacgactgctgccacggcaggtcgagcccctgcccgaaattgcgcacgtacagcagctcgcgcttctcgaaacgcgcgacgagcgccggatcgagcgcacggtagacggcacggctgtccgcgatcggcgtcgccccgcccttcggcgcggcgagcgcgcagtggaaccagatccgcagcggccattcacgcgtatacgactgctcgttgtgcagcggaatcgcgcggtgcggcggatactcggtcgacgtgtagacggcgccctcgacctggctgcgcggtgtcgatgcgtattcatagccgatcagcggatcgccgaacgacgccgcgaactgctggaacgcgtcgatcgacggcacgtgaaaacccgtgaacagcacaccgcccgcccgttcgagcgtgtcggccgcgatctcgcgcgccagcggcgcgacgtcgtcgatcgacatcccgtcgctgccgcgcggcgacacgacggtgggcagccccggctcgatacgcaggtcgtcgagcgtcggcaacgaaagcagggtcatgcaacgtcctcttcaggtggcgcgccgcccacgcggcgcggcgggtcacgacgcgcgcgatgcgcgctcgccgtccatcgcgcggcgcaggcttgcggggcgcatatcggtccagacggtctcgatgtgcgcgagacagtcggctttcgggccgctcacgcccacttcgcgccagccggccggcacgggccggaacgtcggccagatcgaatactgttcttcgtcattgatgacgaccgtatagacgagatcgtcggtgtcggcggaaggcgtcgtggcttgcgtcatgatcggaaatcgctgaggcggttgaaagtggcaaagcggatggcaaagcggcgggttcggccgctcctgtctgatagacgattggccggcgcgtttttacccgcgcttaccggcgccgcgtgcggccgcccaggaacaccgggcacgcgacaccgcgatggcatgcgtcgaggcattccgcgcagtggcgctccgcgtcgcgcaccatgaaatgcacgagcgtctgcgacacgttcagcgcgcgcgccgcggtctgcagcgtctcctcgcgcagccgcaccatctcgaaggccgcgcggctgcgcgccggcaggtcgtcgagcgcggcccacacgcgccgcagcgtatcgcgcgtcagcagtgcggcttccggcgtcggctcgggcgacggcacgtcgaagccgtcgtcctcttccgtgtgatagacgttctcgaggttttgccggcggcacgcgtcgatcgacgcattgcgcaccatccgcgtcacgtacgcgaccggctggcgcaccgcatcctggttcgggaattcgacgagcttcacgaacacgtcgtgcacgacgtcctcggcacggctcgcgcagccgacgaagccgcgcgcgacgttcacgagcatcgcgcgatgcgagatcagcacgtcgagcaacgcaccttgcgcacggggctccgtggcggggcgcgcacgcggcggccggtcgggatgactgccgaggaacgggttcgccgctgccgccgccggtcggtcgagcacttccgccatcgccatcgatctgctccgtcaaattccgagatagcgcaatttaacgtaaacgcaaatcattctcaatctgattacccaatgaccctttcagtcgacaggatttgtctgaacaattgacgaaatcgttgcccgggtggagggacgcacagcggctggttcggtacgtggtcatcggctaatccgaacggcgcgaccggcctgcgacccaccgacacgacctttcacgcgtctgacaacgcgcctgcacgtgtcatgtgcggtagcaacttcttactacgtgaaattttgggggctcgtacgatcgggggctgtttccaagggagaaaccatgaaatccatcgtgttgtccgctgtcatggctggcgcgctgtcgagcgtgatgctgaccgggtgcgttgcctatcccgccggtccggctcaggtcacgatcggctggcatggcgatcgttactgggacggcaatcgctactgggagcgccgcgactgggaagcgcagcatccccgcggatatgacgaccgccgggacgaccgacgcgatgaccgtcgggacgaccgacgcgacgatcagcggccgcagtggtaaggcgttccctcttcccgtgattcacttttcaacgatcaggactgcaacatgaaaacgctactgaaatcgctcgccgtcacggcgctcgccgccgccgtgctcgtgccggccatcgccgaagcgcatccgcaccgcgtgtgtcacttcgaccatcaccatcacaggatgtgtcgctgggtgcggtaaacgaaacaaggcgccggaaaaccggcgccttgtttcatcgcttcacctgcgtgcgaccacgctcgttagcgcgtggccggcaaccgcggcaggcatcgcgcgagctgcgccgggctgacgggcatgcggcacgcgcttcgctgcatcgctgcgttcggcttcgccgccagcatgcgtgacgccgccttgagcggcgaagcccgcacccgcaatgcgtcggcgcccgggctcgccggctgcaacgcgcgcagggtcgccgcatcgatgtgcacttgccagaactgcggccgatagtcgggatcgccgtcgcgatagccctgccccgtgatggtctgcccgtcggggctcacaccgatcacgttggtcaggttcagcgtgccgaccgacaggccggccgcttcgagcaacgcaacgaggctgcgcatgccgctttgcggcgtccacacgaagacgcgctcggcaccggtctgcccgttgctcgatgtgccgatgacgacccgcccgtccgtgctgatcgataacgcgtagctactgtcgtcgccgtcgagaaaaccgagccgctggatgctgtcgccgccgttcgtccacagcacggcctccgagtcgacccgttgttcgtccggcgtgactaccagcgtgccgagcgagccggcgatcgtccgttcgtcttcggtcacgccgcgggccatatccattctcgccacgcccgcgttgatcgtcggcaatagtcgttcaccgattcgttctgtccaaaggagcgcacgcgagccatacacgccgtcgacattgccggcgaaccctgctgccgcattcccggacgaggtcatcgacaggagctgcacgccatagtcaccgcccggcggcaactcgcggaaacccctcggctggtcccacatgaaccgtgcattccggccgtctgtcgccgtgaagctgcccgtcatcctcgtgccggcgaggttcgcgacttcgaccgatgcgtcccggcccgccgtatccggaacgagtttctgtgtgcgaccgtcgccgggccatcgcaccgcccatcgatcgaggttgctgctttccggctggcgcgcactgatcgagccgccgatcacctgcccgtcgcccgacaccgtctgtgccagcgagtcataggcgttcgccggcgcggccagccgttgccagcccgtcgcggccgaccacgagaaggccatcgagttaccgggctgcgcgtcgctccagtaggagccgatgatcgtcttgccgtcggcgctgacggcattcccgttgtaccgcatgtcgcgcggaccacccaggtcaccgatcacggtcagcgaatacccccgccgataccgtctgtgcgtgagccgcgcccaccgtcgaagcaacgaacagtgtcgctgccatggtgcccttcagatgcattttcatctccccaataagcgctcgatcgtcgccctgccagggcctcgtgcgcgtcagtaaataaacaagcggatcgtcgccgttgcgtcgaaccttccgatcttcggtggtccgaacgacttcagcaccgcgtccatcaacacgctctggttcatgacgttcgacgggaattgcgcgagcgtgaactgttcgttgaatggaatcgccttaccctggctgtcttcgatgccgataccgaaattgctgtccgacgcgggcaccagcaaaccgttccgaaccggaaagctcgtttcgaagtacccatcgaccttcaccgcgacattgcatttcttggttagcgacaacgagaagcgtttgcgcggcaccgccggcagaaagccattgccgaccgactgtacctgcccgaaattgacgatgcccggttcgggcgtcaccagcacgtcgacgaagcacggtgtcggcttgagattgcgcatgccgctcaggcggtactggaagctcgggtggatcgcattcagccccttcgctccgtcgaactggaataccgtgtagatgtcgctcggcggttgcgtccacgagccgcgcttgcggacgaccacctgataggaaatgtcgataggcaccttcgggcattggccccatgccagtttttcgtcactgcacgccggtaccgtcttgcccgtcgccacgccggtgccaggctgactccccgcgccaaagtggtcctgtcccaggtaccggatgccgatttcgagcccccaggcagccgggttctgcttgttcggattcgcgtagaaggagatcggatcgtcgatgtcgatgttgcccttgccgcccagatccttgaagcaataccccgtcgtcgtgcgaaccggcgacacccagatcacgtagccgtcaggtgcgtcggtcggataggaggcgacaccgccgatcgattccgtcatcgacgtcgcaccgctgctggtcacgcagcgtacggcaaacgccggctgcatggcggcgaccagcaccgcgaagatcgccaggcgcagccacgacgccatcgtcaacatgcgggggcctgtcgtccgcccccgctcatttcttcacgctcttgcaagcaccggcctcgcacgcatactcgaccgccacctggccgccgtaatcgtcgatgtgcgtgacgaacagcgtcgcgggcgtcgcggccttgaacggcacgtcggccgtgctcatcgggctgaccatcaccggctccagcggcacgtgcgtcttctgcacacccgccgctacgtcgacgatcgtgatgtgatacggcgtcggattgtcgaacacgagcttgtgcgcggccgcatcgacgcgcaacgtcatcggcagcgtccagtcctcgtcgcgcgcgggctgcacggccttcggccggtagaacagcttcatctgcgtatgcagcgcgatctgcagcgtgttcggcgtatcggtcttcggcggcacttcgcggatgttcaggtagaacaccgattcgcgatcggccggcagctcggtgcccggcagcttcgcgatccgcagcacgttgcgctcgttcgcctcgacgcgctgcagcggcggcacgaccatcagcggcgacgtgatcttgttgcccttcgcgtcctcgagccacgactgcacgagatacgggtacgtcgtgctcttgttggtgatcgtgacgaccgccgcctgttcgccttcgttgaagatcacgcgcgtgcgatcgggcacgatcgccgcctgcgcggcgcctgcgaggagcgcaccggcggtcgcgagtgcgcaccatgcgcgccgcgaaaggaaagggagaaggagtttttcatcgctggatccgtgaattcatcgttcgacccgtgcggccgctgcatgcgactcaccgggcgtctggcacgtcaccggaatcggcgtgccttcgagttggagctggttcggcagcgtgtcgatcgtgcagagcgtgcgttcgcccgcgcgcaccgccagcgtggatttcggttgaacctgggtcaggaacgccgcgccgccctcgccgacgatgccgagttccttgccgttcgctatgtcctgcaccgatgcgccgaacggcagcggcttgccgaccgggtcggtcagtgtcaggtacaggttgctgccacgcgcggcggagaacttcacgaagccgatcgcgccgtcggtcagcaccatgcgctggatcgggttcgacacctgcacctcgagcggcagcttctcgacgttgaccgtcgcgtcgtagacgttgtacggcgagatgccgtcgagcaccgtataaccgcgcgaatcggtatgcgagagcgtgccggacagcggcacgtcgggcacgccgtcggtcgacaccagcaaccgcgtgtcgcccgcgttgccgttcgcgtgcgccgcgacgccgtattgcgtcgcgacaaacgagccgtcgacttcgagcgacgcggccgcatacgcattggcgagcgtcgacgcctgcgcggtcagctgatacgccgacgagcgctggcggtagctcgcgttcgccgacgcccgtccgtcggtcgcgcccgcgttgacctggtaggtgcggccatccggatcgtcgtagatataaccggcgttcacgctcgtgctgccgctgcccgtcgtcaggttcgacgtgacggtgtggcggccgccgatcggcagcgtcgcggtgaccgagacctggttgccgcttgcaccggcgctctgcgtgcggaacgccgatacgctcacgttcaggttgcgcagcgtgccgatcgagaacgcgcgcgtcagcgtgaggccgacgcgctgctcgttcgcacgttcccagtaggtcgtctggtcgtacgagaaatacgtcgacgtgtcgccgaaacgcttcgacagcgtcgccgagtagcgctgcttgctgttggcgaggccgtacgcggtcgggtcgcccgagaactgcgcgaagttcgtgtattcgcgctcggagaagcgataaccgaagaaacgcacgtcggcatcgagcccgtcgaagtgcttcgaatagttgatgcggtacgagttgccgttgcgcgtcgcgccgttccaccacaggcgtgcccgcgcatgcgtgacgtcggccgacagcgcgccgaacgcgccgaagtcgcggcccacgccgagcgcgatcgacgtgtagcccgacgcggcgatgaaaccgccatacgcggtgacgtcgaacggcaggccgtaggcgatttcaccgaagccgaagaacggcgtgatgccggcgccgccaaagagccgcggcttgccgacggcggccttgtagcgcaattgcccggcgcgcgcgaggaacggcacggcggccgtcgtcacctggaagcgctgcacgctgccgtcctcttcctcgactgcaacgtcgagcgtgccctgcacgctcgtattgatgttctgcagcgcgaaggcgcccggcgacacgcgcgtcacgtacaacacacggcccgcctgcgacacggtcaccgtcgcgttggtgcgcgcgacgcccgagatcagcggcgcatagccgcgcagcgaaggcggcagcatgcggtcgtcgctgcggatcgacgcgcccgtcagcgcgaacgtatcgaaaatgtcggacgtcaggtagtcgtcgccgaacgtcaccgtcgactggatcgacggcagcgcgcgaaatgcataaagccggctgaagcggaacgtgcggtccgcgtaggccgtattgcccacgttcgattgcgcctggtagtcgccgcgaaagcgccatgcatcccagttcgcgccaaccgtcccgtaggcctggatcgaattcgtttgcccgccacccgtgccgaagttgcggttcgtgttcgcgatcacgcgatagtcgagcatcgcgccggggatcccttccgaccagcgctccggcggcaggtaggtcgtatcgttgaactcgagcgcagcctgcggaatcgtgatcttgagccgcccgtcgcttttcaggtagcgcacggtcgcccctcgatcgcgccgagatcgacgcaacgtccgccctggaagcgcggcaggtccttcgcgagcgacggcttcagcccgaactgcgcgacgagttccgggcgcaggcacggtttgccggcccccgacgcgtcgacggcgatgaactcgatcgcctgcagcccgtagaacaggtcgttgacctgaacgtcgagcatgtactcgccgggcagcgtgaagtccgcctgcgagaactgcgacagatcgacgttgttcgagccgtcgatgctcaggaacgacgaattgaattccgtcgcatggctctggctgccgacaaccagcacggagacgcaaaggaaggaatgtctgattcgcacgcggcgctaccggaagtccaacgaagggaaatgaggaaatacgaacgaggaagggtgcgcgcacccttccccggtacggcggcttactggtagcggacggtgaagttcgccacgccttcggcggtacccggcgtcacgccggctgcggtcgcttcgtacatggccgcgaagcgtgcgacgttcgtgccgttttgcagcacggtcggtgccttctgctcggcgccgttgtcgaggtattcgcccgacgctgcctgcaggcggatgccgacgttggttgccgaaccgatcgtggcgagcagcttcggctggcccgcgctcgacgtgcccgtgaacgtgaagtacgcgttctgcgcgacgctcgtgtcgcagtcggtcagcttgatgtcgaagttggtcggcgtggacttgtcgccagcttgcttgaacacgttggtcggcaccttgccgaggttcacggtctggttgaccgagcccgaatcgatgccgcatgcgcccgcgacgatctcgcccgtgaagttgatcgtgccggtgcccgctgcgaaggccgaggtcgacagggccgcgagtgcgacagcggtcaggatggatttttcatgacgtttcccgaaaggactgcaaatggaatagatgacgtggcggacacaaacggtagcgtgtggtggctcccgtccgtcacgaggcggcattatcgagataatcgtgaaagttttctgtaaatcattgtcaaatgcatctgacaatgtccgatttaccctctagatccgcactatttcccgtcaattttcaatcccggaatttttatccgcagtcctttttattcttcggaaacaattgaagattaaggatattttcgatcgataaccacaacctccccgcgcacccttgctggcattggctccggcaaatcatcctcgaaaaggacaaaacattgtccatagccgccatcgttgtccgacgacaacgccaatatcaaatcattttcaacaaacaggaaattaaccggcgattcaatcaatacaatttttcgcgcaaacgattgcgacatgaatacaaacgttttaccgcgacactttgccgccctcattatttccgatatatggttaattcgtttgtcaattccggatcgtaaatcgcacgcatgagcggtcgccggaacccgacatcgggaccgcatcgcatgggagaaagaaggcaaaatgacccgcacacgtttgcgcggaattgcgacacgagcgatcgcaagacgacggctgttccgcaacgcgcacgcgcgcgttgccgcaggatgaaaaacgtcccggccggcctgtcgatggggaaagatatcgctggaaccagcggtatggatcgaaggaagcggcggcagcacgtcgaaacgtaccgccgtcatgccgcccgacgcgctgcggcgtcaggcgacgggcattacgcggaagccgcggcctccgccgacgccggcgaccagccgccgccgagcgcgcggtacagcgcgatcgcattcgcgagcctgagctgcttgagccggatcagttcctgccccgactcgtacgtgctgcgctgcgcgtcgaggagttcgagatacgtcgcgacgccgcccgcgtagcggcgctccgcgagcttcagccgcgcgccgtcggccgcatacacgtcctgctgcgcggcgagctggcgatcgatccagtcgcgcgcggcgaatgcgtcggccacttcgcggaacgcggtttgcaccgtcttctcgtaatcggccaccgcgatgtgcttgcgcgcgttcgcgacgtcgaggtttgcgcggttgcgtccgcccgcgaagatcggcaacgtgatgcgcggcgcgaacgtccacacgctggtgccgccggcaaacaggctcgagaacgcatcgctgaccgagccgtagtcgctcgtcagcgtgatgcgcggaaagaacgccgcgcgcgcgcgccgatctgcgcgttggcggccttcagccgcgcctccgcctgccggatgtccggccgccgttcgagcagcgcactcggtgcgccaggcgccacgggcgcgatcgacagcccgtcgagcgcggtcgtgtcgccgggcacgttgcgcgcgaagtcgcccgcgagcaattgcagcgcgcgcaccgactgcgcatgctcgcgctgcagcgcggcctgcgatgcgcgcgcggatgccaccagcatctcggccgagcgcagctcgatcgcgtcgctcgtgccggccgcataacgacgctgcgtgagcgcggccatgcgttcgcgcgcgtccagcgtgcgctgcgccagcgcgagctgctcgtgcagcgagcgctccgacacgtacgcgcccgccacgtcggcgatcacgccgatgcgcaccgtgcgttgcgcgtcggccgtcgcgaaatactcggcgagtgccgcatcggacaggctgcgcacgcggccgaacaggtcgagctcgtacgcgctgacgccgacgcccgcacgatacagcccgctgatcgcgctttcgcgcacgaccgggtcgtactggcgcgcacgctcataacccagattcgcatcgaccgacggcatcaggtccgcgcgctgcacgccgtacagcgcacgcgcttcctcgagccggccggcggcgacccgcaggtcgcggttgttcgcgagcgccgcgtcgatccacgcctgcagcgcggcatcggtgaagtacgtgcgccagtcgtcgagcagcgcggcatcggcgggcgatgccgcggccgccgcaggcgcggcactgtcgtcgaccggcgcataggtcgccggcacgggcgccgccggccgctcgtaacgcggtgcgagcgtgcagccggccagcgcgagcgcggcggccagcgcaacctgaacccgcagcgctgcctgtgcattcagcgcaaacatcattgagaaccctccatcgccgccggctgcgctccgccgcgccggcgcgggccgacgtcgaacaggcggccgacgatcacgaaaaacagcggaacgaggaacaccgcgagcacggtcgccgtgatcacgccgccgagcacgccggtgccgatcgccatctgcgcgccggacgcggcgcccgacgcgaacgcgagcggcagcacgcccacgccgaacgcgagcgacgtcatcacgatcggccgcagccgcaggcgcgcggcctcgagcgcggcgtcgacgagcgacatgcgctgcgcgaccaggtccttcgcgacttcgacgatcaggatcgcgttcttcgcggacaatccgatcgtcgcgatcagccccaccttgaagtagatgtcgttcggcatcatccgcagcgtgacgccgagcaccgcgccgatcacaccgagcggcacgaccagcatcaccgcgaacggaatcgaccagctctcgtagagcgcagccagcgcgaggaacacgacgagcaccgacagcgcgaacagcatcggcgcctgcgcgcccgacagacgctcctcgaacgactgccccgaccacgcatagccggtgccggccggcagcttcgccgcgagttgctcgatcgcggccatcgcctcgccgctgctgtggccctgcgcggccgagccgttgatcgtgaacgacggaaagccgttgtagcgcgtgagctgcggcggcccgagcgtccagtgcagcgtcgtgaacgccgcaagcggcaccatctcgccatgcgagttgcgcacgcgcagcttcttcacgtcgtccggatcgagccggtgcagcccgtcggcctgcacgatcacgcgccgcacctgcgtgccgtgcatgaagtcgccgatatagtcggagccgaacatcaccgcgagcgtcgtgttgatctcatccatggacacgccgagcgcggacgccttcgcacgatcgatgtcgagcttcagctgcggcgcgtcctgcgtgccggcgaacatcaggtcggtcagcgcgggatccttgcggcccgccccgagcagctgttcgcgcgcggcgctgaacgtcgcgtagtcgagcccgccgcggttctgcagccggaagtcgaaaccgctcgacgagccgagatcgggcagcgccggcgagttcatcgcgaacaccgtcgtgttcggcgtgcccgcgaagcgctcgttgatgcgcgcgacgatcgcctgcacgtgcgcgtccgcggccttgcgctccttccagttcttcagcgtgacgaagatcatcccgccgttcggcccttcgccgtacaggttgaagccgccgagcgcgaacgtatacgcggccggctcgtcatggcggatgtacgactcgacttcccgcacgctctgcatcgtttccgcgagcggcgtgccttgcggccggatcaccatcaccatgaagttgccctggtcctcgtccggcaggaacgcggtcggcagttgcgtgagcatcagccccgcggccgcggtcagcgcgccgtacacgacgagccagcgcaccggcttcttcagcatcttgcccacgcgcgtcgcgtagcgctgcgtcgaacgcgcgacgaagcggttgaaccagccgaagaagccgcgcttctcgtgatgttcgccggacacgggcctgagcagcgtcgcgcacagtgccggcgtgagcgacagcgcgaggaacgccgagaaaccgatcgacaccgcgagcgacagcgcgaactgccggtagatgttgcccaccgcgccgccgaagaacgccatcggcacgaacaccgacgtcagcaccacggtgatgccgacgatcgcgccgctgatctgcttcatcgccttgacggtcgcgtcgtacggcccgagccctcctcgaccatcagccgctcgacgttctcgaccacgacgatcgcgtcgtcgacgaggatgccgatcgcgagcaccatcccgaacatcgtcagcacgttgatcgagaagccggccgcatacatcacgccgaacgtgcccgcgagcgcgaccggcacgacgagcgtcgggatcagcgtcgcgcgcaggttctgcatgaacaggaacatcacgaggaagacgagcacgccggcctcgatcagcgtcgtgacgaccttgttcatcgacacgcgcacgaacgacgacgtctcgtacgggatctggtacttcacgcccggcgggaaatacgcggacagctcgtccatcgtcgcgcgcacgcgcttctcggtggataccgcgttcgagcccggcgcgagcttgatgcccatcccggtcgcgaccttgccgttcacgtacgacgggtagttgtagtcgttgccgccgaactcgacgcgcgcgacgtcgcgcagatacagcgcggagccgtcggcctgcgtgcgcagcgcgatcgcgccgaactcggccggcgtcttcagcggcgcatcggcgaacacggtcgccgcgatcggtgcgctcgccggcaccgcggtgcggccgatgtcgccgatcgtcacgcgtgcgttgtacgcgcgcaccgccgacgcgatatccgacgcggtgaggccgtgcccggccatcttcaccgggtcgggccagatccgcatcgcatattcggcgccccagaactgcacccggccgacgccgtcgacacggcgcagcgcctgcacgacgttcgccgacgcatattcgccgagctgcacgtcggtcatccgcccgtcgtcggatgtcagcgacaccacgagctggatgttgtcggcggccttctcgacctggatgccgtcgcgccgcaccggttccggcagccgcgcatcgaccgtcttcagccggttctgcacttcgacggccgcgagatcggcgttgacgccctgcttgaacgtcaggtacagcgacgccgcgccggcgctgctcgtcgcggacgtatcatcagccccggcgcgccgttcatttcgcgctcgatcagcgcggtcaccgattcctcgacgacctgcgcggatgcgcccgggtacgtcgcatagatgctgacgacgggcggcgcgatgtccgggtactgcgcaacgggcagcgagcggatcgcgaatgcgccgcccagcatgatgaagattgcgatcacccacgcgaagacggggcgatcgatgaagaaacgtgccatggtggtgtggtgttaaccggtcaggtttgacgggcggccgcctgcgaagcggccgctgccggcgccgctttcgacggcggcgccttctcgacgggcttgacggccgtatcgggcgcgaactgcgcggcatcgtcgacgatcacgcgctcgccgcccgcgaggccgcgcgtgatgcgccagtcgtggccgctcatctggtcggcggcgacctcgacgtccttgaccttgccgttcgtgccgaccacgcgcaccgacgtgcggtcggccgtgcgcagcagcgcatcgcgcggcacgaggatcgcccgctggtcgaccgccgtgtcgagcgcgatccgcacgtacgcgcccggcagcagttcgcgctccggattcgggaacagcgcgcgcatcgcgacggtgtcggtggtcggatcgaccgcgagatcgctgaacagcagcttgcccttcagcggatacgcggtgccgtcggcgcgcagcagcgtcaccgtgatgtcgtgctgcgcgatacccgtcgcgcgtccgctcttcaccgcccggcgcaacgcgtcgacgtcggcggccggctgcgagaagttcacgtagatcgggtcgagctgctcgacggtcgtgagcggtgtcgcctggtcctggccgacgagcgcaccctcggtcacgagcgcgcgccgtgcgcggcccgcgatcggcgcggtgaccgtcgcatagtcgagctgcaactgcgcccgtgcgagttccgccttcgcggacgcaacgtcggccttcgcctgcgtgtcgccggcaacggcctcggtgtggtcgcgctcgcttaccgcgcgatcgcgcacgagatcgtcgtaacggcggcgcttgtcgctcgccgcgagcgcggcggcctgcgccttcgcgagcgcccctgcgcggcgtcgcgcgcggccttcagcggcgcgggatcgatgcggaacagcaccgcgccctgcttcacttcctggccttcctcgtaggtgcgtgcggtcacgatgcccgcgacccgcgcgcgcacttccgcctgccgatatgcatcgagccggcccggcaattcgacggtcatcggcacggccgtcggacgcaccgtcacgaccgtcgcctgtttcgcggcctccggcgcggtgtccttgtcgccctttccacatccggccagggccagcacggccgccagcgcgaacggcgccagccggtggcgcaacagggagcgattgttattcatatgtgacctcggatcgttcgccgccgatacaatgcggcggctcagggtggccgattataatcagtcacgattgattaaatacacgccgcttcaatctgaccgtcatactgtctcaataaaacgacagcgaactgtaaggaatttcaggacatggcccgcaagacccgcgaagaatcgctcgccatcaagcaccggatcctcgacgccgccgaactcgtgctgctcgagaaaggcgtcgcgcaaaccgcgatggcggatctcgccgaggccgccgggatgtcgcgcggcgccgtctacggccattaccgcaacaagatggaagtgtgtctggcgatgtgcgaccgcgcgttcgcgcgcacgtcggaaggcttcgacgcgggcgacgggctgccgccgctcgccacgctgcggcgcgccgcctcgcactatctgcaggaatgcggagagccgggcccgatgcagcgcgtgctcgtgatcctctatacgaagtgcgagcagagcgaggaaaacggcgcgctgcagcgccgccgcatgctgctcgaattgcagatgctgcggatcacgaaggcgctgctgcgccgcgcgatcgcggccggtgaactcgccgccgatctcgacgtgcatctggccgccgtctatctcgtgtcgctgctcgaaggcgtgttcgcgtcgatgatctggaccaaccggctgcgcggcaacctgtggaacgacgccgaggccatgctcgacgccggcttcgacaccgtgcgcacgtccgccgcgttgcgcggccgcgcgcacaaattgccggactgacgaaatttgtcgtaataaatgctgatttaacccgatttaccgcactgcgaaacgaatgagctgaccctctttaaaatttttaacgttgtgcggaacaccggtagactggcgctgtcatctttctttagcgtcttcgtgataaccgggttcgacccggtatgcacgccgccgttcgaagcgggcccgccccgcgcgttgggtcgaacggaaacgacacaggccctggcggggcctgttttgttgcacgcccgccgcccgcccccgtcgccgcccgacggatgtgccgccggcggcctgcccacacccctttgaaccgctttcctggatgtggacaccttggtcaagtctgccgctacccctgatgctttcgcgcccggccgcgcgcagcgcgtcgtgcgcgctcgtgccggccgccgtgctcggcgccctcgccgcactcggcctcgccgcgctgccggccgtgtcgcaactgccgggcgctgtcgactcgggcacggccgcgctgccgcagcgcgtgctgtccgacacgccgtttcccaccgcgcagcatttcgtgacgagcgagctcgcccgcacgatcggcgagcgcaacgattccgacgaacaccacgaccgcagccagcagccgggcctgttcgcgccgcttagcgcgcaccgcaacgacatgctcggttatgcgaacctgttccagttcgcggccccgaaaaccggcacggcatgcgcgcgggcgacatcgagctcacgctgtccgacacgctgaatcgtctcgacgtgccgcccgaggtgcgcatccagctcggcgatctcgtcagcggcaaggtcgcgatgcgcgcgagcgcgcaacgcggcgactactaccgcgtcgcgttcgatacgaacgacggcacgccgcgccttaccgcgctcgagctgcgcgtcgccggccgcacgttcggcgcgatctggttccgcgcgccgggcgccgagcacggcgcgtactacgcgctcgacggctcgccgctcgaagccgccgcattcacgatgccggtcaaatggactcgcatcagctcgttcttcggcgagcgcgtccatccgctgtcgcaggcgatggcgttccacacgggcgtcgatctcgccgcgccgaccggcacgcccgtcgacgcggcggccgacggcgtcgtgtcgttcgtcggcaccgatccgggcggctacggccgctacgtgatcgtcgatcacgccgacggttactcgacctactacgcgcacctgtcggcgttcgcgcacggcctcaagacgggcgaaaccgtgaagcagggccagcgcatcggctcggtcgggatgaccggcgccgcgacgggcccgcacctgcacttcgaggtgcgggtcgcgaacaatcccgtcgacccgctcgtcacgctcgcgagcgcgcagacggcgctgtccgacatgcagctcaccgcattccgccaggaagcggcgcaatggcgcttccgtctcgcgtcgatcaatacggcgccgttcgcgttcgcgcagaacgacgggccgctgtggggcgatttcgcgaccgacacgtcgacgctgcgcgcggtcttcaatacgcactacgccgcgtcgtgacgcaccggccgcccgccgtcgctcgacgaacagcggcgcgcggccgcccctccccttccttgtgcgtgctgcccgccgggcccgaccaagcccggcgcgttgtccgccgcgaagattccgcgacactgccgcctcaccggcacgtcgatgcggccgcggctcgccgttaccgcgccggttccgtgtactcggccgccgcatccgcggcgcgttgcgtgcgcgggcggcgtgacaacagccagcgtgccgcgccgtcgagcgacgtacacagcaccaggtagatcagcgcgacgaacaggaagatctgcgccggatacaccatcagccggttgttcacctgcgtcgcgacgaacgacagttccggcacgccgacgatataggcgagcgacgtgtccttcacgagcgcgacccactgattgatgaacgacggcgtcatgatccggatcgcctgcggcagcagcacgtagcgcaccgtctgccagcgcgtgagaccgagcgacagcccggcctgccattgcccgtcgccggccgcgacgatgcccgcatgcaccgcgtgcgcgagatacgcgccgccgatcagcgcgagcgcgcacacgaccgtcgcgagccccggcacgtccatgtgcagcagcacgggcatcaggaagtaggtccagaaaatcagcatcagcacgggaatcgcgcggaagaagccgatgaacgcgagcagcagcacgcgcgcagggccgcgcgcgagcgccatggcaacgccgagcgcgatgccgagcacggccgatgcagcggccgacgcgatcgcgagcagcagcgacagcgcggcgccgccgagcggcccttccgggaacgcgccgacgagcaggtacggcagattgacgagcagcagcgagaaatccatcgtcagcgccccgctcccagccggtcgcgccattgcgtcgccgcatacgcgcccgcttcgatcgcggccaccgccgcgacgtacagcacggtcgccacgccgaatgcggcgaaggtcttgaacgtttcggtctcgacctgccgcgatgcatacgacagctcggccacgccgatcgccatcgcaagcgacgagttcttcacgagattcatgtactggccgaacagcggcggcaacgcgatgcgcacggcctgcggcagcaccacgtagcgcagcgactgcatcggcgtgaggccgagcgcggccgccgcatcgtgctgcgcgcgccgcacgccgcgcaggccggcttcgcattcctccgcgacgaacgcggccgtatatgcgctcagcccgacccatcccgcgacgaattcgaacgacggccatgcgagcgtgaacggacccatgctcaacgcatggcgcgcgttcagccatgcgacccacgtgtcgggcagcagcgacgcgacaccgaaataccagaacagcaactgcacgagcagcggcgtgttgcggaacgtgacgacgtacgcggctgccgccgcgcgcggtgccgtgccgcgcgcatgccgcatgaccgcgagcagcagaccgccggcggtcgcggcgacggccgacgcggccgcgagaccgagcgtcagcaggaagccctgccagagccaggacagatatttgggagccaacccgagcatgctgtgttgcgggcgcgaagcgcgcgatcggaagaaaacggaaagcgccgcgaggccggtgatccggccggtcgcggcgcgcgtgcgatgcggatcaggtcttgtcgccgatccggaagatgcgcgtgagcggcgtcttcgtcgtcggcccgaaccatgcgtcgtagatctgcacggcgcggccgttcgcctcgagccccttcagcgtgtcgttgacgaagccgagcaggcgcgtctcgcctttcggcacgccgacgcccatgtagtcgttcgagatcgtgaacgccgggatctcgtagttctgcttgtccggcacgttcgcgagcaggccgatcagcttcgggccgtcctgcgtgatcgcctgcacgttgccggcgcgcagcgcggcgaacgcgaacggcgtgtcgtcgtacgcgacgatcgtcgccttcgggaatttctcgcgcagcgtgatctcgttggtcgtgcccttgtcggcgccgacgcgcagcccgttcagctggtcggccgatttcagcacgcccttcttcgcgagaaactgctggcccgacgagaaatacggaatgctgaaatcgacctgcttcgcgcgctcgtcggtgatcgtgaagttcgcgagcacgagatcgaccttgccggacgtcaggaacggaatgcggttcgcggggttggtcggctggagctgcagcttcacgccgagcttgtcggcaagcgccttcgcatagtcgacgtcgagaccgacgatgtgattgcttttgccgtcgacatagccgaacggcgggttgctgtcgaacgtcgcgacgcgcagcacgccggccttcttgatatcgtcgagacggtccgcatgcgcgacggtgcctgcggtaatgagcgcagccccgacgagccacgtagcgagagtgtggattttcatgagcacgacctgatttgttatgaaggccgccgcggatcgcgcggcggcccggttcgaagaacatcgcgacggagtgtgtcgtcgcgaagccgctaacgtatcagcgcgtgcggcgaatccgaaccaacaaatggtgctttgctcagcgggtttcgtgatgaggctggcggcgcggtcacgcgccgtcagcgccctcttccccgtccgcggacaccgcacacaggaattcgcctgcgtccgtgtcttgcagataatcgagcgagcggtccatgctgaggaacgacagcgtgcccgcagcgcccagtgcgtagagcgtgcgatggtctggcgcgaagatcacctgcgacacgccgcccgccaccggaaattcgccgaccgttcggcgggtcgccaccttgatcacgcgcatcggcgaaccgtcgtacgcggtcacggcgatcagcttgccatcatcgctgccgtcgaagctgtgtgccgaagtctggcagaccggataggtcttcagcgacgccaggctcgccgggtccacccatttgaccgacgacgcgccgtagaaccatgttcccgcgcccggcgcgcccggttccgcccggatgaaacctgcatcgagcggatacgagcggagcggctcgttcgtcgacgtatcgaacgcgacgatcgtgcctttctgcattgcgttgacattcagttgcttgccgtccggcgacagccacatcgacagtgaccgcccgaactcgacgcccgccccgtcgccatcacccagtttcagcgtcgcgacgacctgcggccagtgcgtaatgctgacgacggacaccgtatcgtcgacgccgttcagcacgtagagcctgtcgtgcgatgccgatgcgacgatcgcacgcggaaaccggccgagcaccgcactgtcgacgatcttgccgctcgccagatcgatacgtacgacgctgtcctcgcgcatcgacgccacatacgcatagcgctcatccgggctgacaactactccgctcgcgccgcggccgcggcacatgttgcttggacaaccgttgagccccgtcttgaatggctcgccggcaatcgtttggaccaccgtgcgcttgtcgacgtcgacgacgacgagcgtgttctcgtcgttgtcggtgatgtacaggcgcttgcccgacgctcccatgaccattgcataggtacccttgccgaccgggacgaccgtgcctgcggccagttccgcggacacgggtgcggcgcgatgctgctcgtcctcgcggatctgctcggcgatcgtgtccgcatcgcgcttcgcctgctgccgcgcgtcgtcctgcgcacgctcgcgatccacggccgtgcgtagctcctgcagctccgcgctgcccgcgcgctgcgccgcaaacaacatcacgccgctacccagcaccgccagcgtgaccggcagcaccgcgccacgcagcgaagcgcccgaaggacgaaaaccgtacagtatccagccggcgacgaaacccgtgacgacaccgccaagatgcgcagcctggtcgataccggaaatgaagaatcccgacgccaggttgatggcgatcacctgggccaccgcgccgagattgatgacgacgcccgcatcgcgaccgcggtccgcacgccggtgcaatgcgagcgcggcggccgcgccggccagtcccatcagcgcgccagacgcaccgacgctgacgaccgggcggatgccgctcgtcggcatcacgatgccgaacgcgacctgcattgcgctgacctcgtgatgcccggaccagagcgcgctcagcagcgagccgccgagcgccgacagcaggtacgcgacgccgaaccgcagtgagccgcccgcgcgctcgagcacggtgccgagcacgatcagcatgtaaaggttcagcgccagatgcagccaaccgccgtgcaggaacgcgctggtcagcaggcgccacggctgcccggtcagcgtatatggcgcgaagttggcgccccagccgagcagcagactgttcgtcagcgcaccgtacgatgcctgtcgccacatcagcacaaagacggcgaggttgacgacggccagcaggatcgtcaggcccggaacggatgatcgttgttctttcatggatatttttcaatcgtcgatggcgcctcggacaggcgttggcgattgtatatcctggacacgcgaatgatcggaacaaaaagacgcccgctgcacgcagcgggcgcgaatcccagtcaaggaggtgtcacacgaactacgggttcaggttacggaaatcgtccgcaacggacaacgaatcgatttcgataacgatatgacgcgacacgctcaccccggctgctgttgcgtggtgcagtggatgccgccgccacccgcggcgatgccgtcgatgttcagctggatgacctcgcggccgggaaacaggtcgacgagcgtgtcgcgcgtattgcggtcggcgcgactgtcgccgaattgcggcgcgatcaccgcgcgattgcacacgtagaaattgatgtagccggccgcgaactccgcgttctcgtattggtgccggacggtcttcgggccctgcagcacgacgaccttcaacgggcgcccttcgcatcggtggatttccgcaggatctccagatgctgccgcgtcaccgcgtggtcgtacgacgaagggtccgtgtcgagcccggccaccacgacgcccgggctcgtgaagcgcgcgtagaaatcggtatgcccgtcggtgatgtccttgccggcgatgcccggcaaccagatgatcttcttcagcccgagcaggcggctcagctcggcttcgcactgcgcctgactgacgcccggattgcggttcgaattgagcacgcagctgcgcgtgatgatcgccgtgccttcgccgtccacctcgatgccgccgccttccagcacgagcttcgtgtcgatcagccgcgcaccggcgcgttcggccacgaacggcgcgacttgcgcgtcctggtcgtgttcctgcttgttgccccagccgttgaaattgaagctcacgccaccgagctggcccgacgcgttcttcacgaacacgggcccggtgtcgcgcatccacaggtcgtcgaccggatgctggacgagttcgaccgacgaaccgcacaggcgcgacgcgaccgcgtaatcctcttcccgcaccagcatcttgaccggctcatgcgcggcgatcgctttcgcgaccgcggcaagatgctcgcgcaccaccggcagcagccgcgcgccccagatgtccgcgctcgggccgaacgccatccaggtcgccgtgtgcggcgcgccttcgtccggcatgtgccaggtggcgccctgctgcgcatgcgcggcgcggccgaacaacccgcccatcgcgccggcggccagcgccgcgcccgagacggacaggccgcgtttcaacagttgacgtcgtgtagtcatggcattcctctttcgcttgccggttatttcagttatttcggttgttgcagggcgggccgtcacggtcgcgccgtcttgaagccgagccaggtccggccttcgagacgcatcgcggccggcgattcggcgatcggcgtgaacagcgtgcgccgcgtcgattcgtccggatagacacccggatcgcgcaccagcgccggatccatcagcttcagcgcgccctggttcgcattcgcgtagcgcgtcgagttcgagatcttcgcgatcacgtccggacgcaggatgtagttgatgaacgcatgcgcgttgtccggatgtttcgcggatgccggaatgaccatcgcatcgaaccacatcagggtgccgatccgcggaatgtcgtacacgacgtcgcgcttcggatcgcgcgccttcgccttctgcgcggccaggttgatcgcgccggaaaaaccgaccgttacgcacagctcaccgtcgatcagctcgttggcgtcggacgaacccacgaactcgcggatgaatggccggatcttcatcagcatcgcctgcgcggccgcgtagtcctgcgcggacggatgcatcggatcgcggccgacatagcgcagcgccagcggcagcacggtgctcgcggagtcctgcaggcccaggccgcacttcgcggcgacgcgcgacgcgatctccggcttgaacagcaggtcgaggctgtcggccggcatgtcctggccgaggatcgcgcgcaccctggcgcggtcgtagccgacgcccacggtgccccacatgtacggcacgccgtactggttgccgggatcggactgcgccatctgcttcagcagcgacggatcgagatacttcaggttcggcagccggtgcttgtcgagcttgcgaaacacacccgcctggatctgcctggccatgaagtcgttggtcggccacacgaggtcgtaaccgctgttgccggtcagcagcttcgactgcagcgtctcgtcgctgtcgtacgcgtcgtagcgcaccttgatgccggtttccttctcgaagccggccagcgtatccggcgcgaagtaattgctccagttatagaggttcagcaccttctcttcgtcggcgcgcgccgttcccgccagcacgcacagcgcgaggcccggcgccgcgacacgcaaccatccttgccgtttcatcgggcctccctcatcgatagcaggacgatacgccgtcgctggtcagcaacgtgcgatacatctccgggcggcgatcgcggaagaagccccacgattgccggtcggcgcggatcgcgtcgagatcgaacgtatgcacgagcaccgcctcgtcggtgcggttcgcctcggccagcttctcgccggtgtgatccgcgatgaagctcgacccgtagaacacgccggtgagcgcctgctgctgcggattgccgttgccgaagccggcttcgcggccgatccggttggccgccaccaccggcaccatgttggcggccgcgtggccctgcatcgtgcgctgccagtggccggacgaatcgaacgcactgctgaacggctccgagccgatgatggtcgggaagcacaggatctcggcgcccatcagcgcgaggcaacgcgccgtctccggataccactggtcccagcagatgccgatgccgatccggccgaagcgcgtttccacaccttgaagccggtatcgcccggtgtgaaatagaacttctccgtatagcccggcccgtccgggatatgcgtcttgcgatagacgccgagcacgcgcccgtccgcgtccgccacggcgatcgagttgtacgcggcattgcccgcacgctcgaagaagccgatcggcagcacgacgccgagttcgccggccagcgccgcgaaacgggcgatctgcgagttgccttcgaacggctgcgcgagttcgagatggcgcacgttctggtcgaggcagaagtacggcatcgcgaacagctccgggcacagcacgagattcgcgccctgcgcggcggccgcgcggatcaggcgctccgcggtggccatgttgtcttcgagattccagctgcccgacgccatctggacggcggcgacggtgatgtgtttggacggcattgcgattgctcctcgatggaaccggaaaccgctgacgggacgtcgctcagtgcgcgacggacggctgctgctgcgtcgaacagtggatgctgccgccgccgatcgacagcgtcgggatcggcagcatctgcaccttgcgcgtcgggaacgcccggctgaaagcgtcgcgtgcggcctcatcctgctcgacgccgaatgcggtcacgatcaccgcgccgttcaccagaatgtagttcgcatagcagtcgcagtagcgctcggagccgaagcgttcgctgacgatcggcgacggcaggtcgagcagctcgaaacggcgccccgccgcatcggtcgcgagttccagcgcgcggcggttttcccgcatcacgcggaaatagtcgccctgttccggcagtgcggtctggcacagcatccggcccggtgcgatgaacgacgcgatgccgtccacgtgcccgttcgtctccacttcgtcggggttgcccggcagccacacgatcttctcgacgcccagcatgcggcgcaattccgcttcgatctccgcgcggctcaggtgcggattgcggttgggatgcagcaggcagctctcggtcgtgaccagcgtgccctgcccgtcgacgtagaacgagccgccctccagcaccatgtgcgaattgaagatctcggcgccggccgcgcgcgcgatgtcctgaccggcctgctggcagccgtcgtacggctggtacttctcgccccagcagttgaagcggaacacggccgcgcccagcccgtgccgttcgctcacgaggaagatcggcccgcaatcgcgcagccagttgtcctcggccgcgaccggcagcacgtcgacgctcgggcccaccagttcgcgcgcggcatcggcctggctgtggtgcaccgcgaccacgcagcgctgatagcgcgcgatcgtgcgcgcgaccagcgcgaattcgcggcagacctgcgcgtaatgcgtccccacaggtcctcgcgattgtcgagcaccggccatccgagccacgtcgcgtgcatggattcccattcggcgggcatccggtaaccgcgctggcgagcatcaaagcgacccatcgatccgactccgttgtgattgatgagcgattttccgccaggttaaacttgatgaatattgatatttcttggcagaatcaatcaattcacctcatatctcgatgcaacgcgttccgtccctgaaactactgaccggcttcgaagccgcggcccggctgggcaatttctcgcgcgcggccgacgagctgcacctgtcgcagtcggcgatcagccatcagatccagcaactcgaagcgcagctcgggcaaccgctgttccgccggcgcggccgcggcgtcgagctgaccatcgccggcgaggtcctgcagcgcagcgtccagcgcgcgatggacacgttgcgcggcgggctcgaccgcatcgcgacctacctgaacccggggctcgtcgtgctggtgtgtccggcgccgttgctgcacggctggctgcagccgcgcctcgagcagttgcagcaggcgctgccggacctgtgcccgctgctgtcgaccgacgaaaccgcgcgctacgtcgacgagatcgacgtcgacatgacgatcggcacgcggccgatgctgcagccgggcctggtcgatattccgttcatgcgggacgaatgggtgacggtttgcgcgacgccgctggccgagacgctcgcccgcgtgccgcgcgccgaacacgcgcggcacgcggggctcgtctgcctcgaagcgagcctgaccgacgagcgcatggcgaccgtctttcgcgagcagctgtcggatttccggatgcaggcgatctacgacgaccagcggctcgtgctggacgccgtgcagcgcggccgcggcattgcgtgcctgccgcgcctcgtcgcgcaggccggcctcgaccagcacgtgctgaccgtgctcgccgactacccgcgcctgcccggcaccacatggtggctgtcgcggatggaaggcccgtcgcgctcgccgatcgtcgagcagatgttcgactggctggtccagcaaggcatcctgtcgagcgtggccgacccggcgcccgaccacgcaccgcctccggccgcgtaatcgaacgccgaaaaacgtcccgccggctggcgggacgttcgtcatgatgcgaatgcgtacgatgcgtggccgatcacggctcgtgacgcaggtacccttccttgctcggatcgcgcatccgccacgacacgatcagcgagatcgcgcacagcacggtcacgtaccagtagaaggtttcctcgctgccgatcgacttgaaccacagtgcaacgtactcggccgagccgccgaagatcgcgttcgcgaccgcatacgacaggccgacgcccatcgcgcgcacttccggcgggaacatctcggccttgatcagcccgctgatcgacgtgtagaagctgacgatcgcgagcgcgaccgtgatcagcacgaacgccgccaccggactcgtcacgtccttcagcgcgtgcatcagcggcaccgtgccgatcaccgcgaacgagccgaacaggatcatcgacgtgcggcggccgatcctgtcggacagcgcgccgaacaccggctgcatcagcatgtagacgagcagcgcgacggtcatcacgttgctggccgtcttcgcatgcatgccggccgtgttcacgaggtacttctgcatgtacgtcgtgaacgtgtagaagatcagcgagccgccggccgtaaagccgaccaccgtgaagaacgcccccttgtgctgccacacgccgcggatcgtgcccgcgtttttcttgtcgcgcgattcggacgtcgacgtctcgtcgagcgacttgcgcaggtacagcgagatcaacgcggccgccgcgccgaccacgaacggaatacgccagccccacgccttcagttcgtcgcccgacagcgtctgctgcaggatcacgagcacgagcagcgcgcacagctggccgccgatcagcgtcacgtactggaacgacgcgaagaagccgcggcggcccttcagcgccacctcgctcatgtaggtcgcgctcgtgccgtattcgccgcccaccgacaacccctggaacagccgcgcgaccagcagcagcgccggcgcgagcgcgccgatctgcgcgtaggtcggcagcaccgcgatcacgagcgagccgccgcacatcatcagcaccgagatcatcatcgcgttgcggcggccgtggcggtcggcgatgcggccgaacagccagccgccgatcggacgcatcaggaagccggccgcgaacacccccgccgtgttcagcagctgcgtcgtcgtgttgccgctcgggaagaatgccggcgcgaagtacagcgcgcagaacgagtagatgtagaagtcgaaccactcgacgaggttgcccgacgaggcgccgacgatggcgaacacgcgccgccgggtgtcatgcgcggacagcgcggcttgttcggtctggacgtccatggattggtctgttccttgtagtactttctgggcgaggcggctgggccgccgcgtgcgatcgaacgtggcaccggttccggcgcacggcgctacgggattttatcgaaatgtaaagtaacaggctctccgggttcgtccggatgtagaaaattttctcccgccatgcgttcgtcatatgaaaacgccagcccgcaggctggcgttcgatgcaaacttcccgcagacgatgttcagatccgcacctccggcggcacgtagcggcactcgtagcgcttgcgcacggtaccggcctcgtcgacgctttccaggaacacgtcgaattgccagagccgcgccatgtgcttgagcacttcgtcgctgtcgttcgacaggtgacggttgtcggtcatgaagtggcgcagcgtgaggctgcggtcgccgcgcgtgttcaccgcccacacctggatgttcggttcgcggtgatggatgtcgtactgcctcgacagtgcctgccgcacatactggtagcccgaatcgtcgtggatcgccgacacctcgagcgaatcgcgcatgtcgtcgtcgagcaccgagaagagccgcatgtcgcggatcaggctcggcgacaggtactgcgcgatgaagctctcgtccttgaagttgcgcatcgcgtagtgcatcgccggcagccacggggtgcccgcgatctcgggaaaccacttgtagtcttcctccgtcggcgcttcgcagattcgccggatgtcgctcatcatcgaaaagccgagcgcgtacgggttgatcccgctgtagtacggcttcgtgacgggcggctggtagaccacgttgctgtgcgaatgcaggaactccatcatgaagctgtcttccagcttccctggttgtacagcgtattcagcagcgtgtagtgccagaacgtcgcccagccctcgttcatcacctgcgtctgccgttgcgggtagaaatactggccgatcttgcgcacgatgcggatcacttcccgctcccacggttcgagcagcggcgcattcttttccgcgaaatacagcaggttctcctgcggctcgggcggatagcggtcttcctgctcctccatcagctcgggcttcttgcccggcagcgtgcgccacagttcgttcacctgcgactgcaggtacgcctcgcgctcgcgccgcagcgcggcctccttcgacagcgaaggcttctgcggccgcttgtagcggtcgacgccgtagttcatcagcgcatggcacgaatcgagcagttcctcgacacgatcgagaccgtagcgctcctcgcattccgcgacgtagttcttcgcatacacgagatagtcgatgatcgcgtgcgcgtcggtccacagccggaacaggtagttgcccttgaagaacgagttgtgcccgtacgccgcgtgcgcgatgacgagcgcctgcatcgtcatcgtgttctcttccatcaggtacgcgatgcacgggttcgagttgatgacgatttcgtacgcgaggcccatctggccgcgacggtagctcttctcggtcgacaggaagtgcttgccgaacgaccagtgacggtagttgacgggcatcccgaccgacgcatacgcgtccatcatctgctcggcgctgatcagttcgagctggatcgggtagatgtcgagctcgtattgttcggcgacctgcgagatgtgcgtgtcgtattcctcgagcaattcgaacgtccagtcggacgggcacggcagcggcttgcgttcggcaacgttcatacgcgcttccttttgccctgggccgggcaaatcggcggccggcggcggcggttcggcctgcccgcgttgctgcggtgcggcagggccggccgtgtcgtcgccggagggcgcggcgcatagccgcgcgactcgttgtgcagatggcgggtcgtcatgacatttccacctgcttttcgaacaattcgcgaaacaccgggtaaatgtcggcagccgattccactttttcatcgcgagatgcggctgagacagggccagttgcgcgtattccagccacaggttctgctcttccggcgcgacctggatatacgcgaagtaacgcaccttcgtgaggatatcctcttccaggattttgcgacacttgggcgaatcgtcagtccagttgtcgccgtcggacgcctgcgcgccgtagatgttccactcggtcggcgagtagcgctcgttcatcaccttgcgcatcagctcgagcgcactcgacaccaccgtgccgccgctctcggtcgaatggaagaaggtgtcctcgtcgacttcctcggcacgcgtatggtggcggatgaacaccacctcgatgcgctcgtagttacgcttgaggaacaggtaaagcaggatgaagaagcgcttcgacagatccttgcgctgctcgtccatcgagcccgacacgtccatcaggcagaacatcacggcctggctcgacggttgcggctgcttcacgcggttgatgtagcgcaggtcgaacggatcgatgaacggaatccgccagatgcgccccttcaggtgatggatctcggcctcgagcaccgcgatctccgcgcgccggtcttccgggtcgctcttcatcgcctcgagctgcgcctccagctcgcgcagctcgttgacgagcggcgagccgagcgcgatgcgacgcccgagtgcgctgcgcagcgaacgcacgacgtcgatgttgttcggcgtgccttccgccgaccatcccgcgcgcacgttcttccagctcggcaccgtcagcaggtgcgtcttcacgaggcgaggcagttcgagatcgtcgaagaagtactgcatgaactcgtcgcgcgacaactcgaacacgaagtcgtcctgcccttcgccctcgttgctcgcctgactgcctccgccgcccgagccgccctgcgggcgcgggatcttgtcgccgcgcacgtagtcctcgttgccggggtgcacgtattcacgacgcccgccaggcgcgtgccggaaattcggctccgcgatgtccttgcgcgggatcgtgatgctctgcgtgctctggatatccttgatgctacggtcgcgcaccgcgtcggacacggcacgacgaatgtagttcttgacgcgacgcagaaagcgttcgcggttggcgatactcttgttcttgccggccagcctgcggtcgatgatttgatgaagcactcccggtctcccgctcgaaagtcgatctgccggggcactcgccgcgcatgccgtctgccgtcatgcgggcggcgcctctgaaggcgcccgtacggtctcgccgtacgggcgcggtaccgcgcgcgtcatgatgacttgcgcacgcgcaggtaccagtcgcaaagcagcctcacctgcttcggcgtatagcccttcgcgaccatccggttcacaaagtcctcatgcttgcgctgctcctccgccgaacccttcgcgttgaacgaaatcaccggcaacagttcctcggtattcgagaacatcttcttctcgatcacgacgcgcaacttctcgtagctcgtccacacggggttcttgccggcgttcgccgcccgtgcacgcaacacgaagttcacgatctcgttgcggtaatccttcggattactgatgccggccggcttctcgatcttctccagctccgcgttcagcgcggcgcggtcgaagctctcgcccgtatcgtgatcgcggaactcctggtcctggatccagaagtccgcatacgtgacgtagcggtcgaagatgttctggccgtactccgaatacgactcgaggtaggccgtctggatctccttgccgatgaaatccgcgtagcgcgacgccagtacgtccttcacgaaggacagatacttctgctcggtttccggcgggaactgctcgcgttcgatctgctgctcgagcacgtacatcaggtgcacggggttggccgcgacctcgctcgaatcgaagttgaacacgcgcgacaggatcttgaacgcgaagcgtgtcgacacgcccgtcatcccttcgtccacgcccgcgtagtcgcggtattcctggtacgacttcgcctttggatcggtatccttgaggttttcgccgtcgtacacctgcatcttcgagaacaggctcgaattctccggctcgtgcagccgcgacagcaccgagaactgcgacatcatcttcagcgtgcccggtgcgcagacggcctcggccagcgacgagttgcggatcagcttctcgtagatcttggtctcttccgatacgcgcaggcagtacggcaccttcacgacgaagatccggtcgagcagtgcctcgttgttgcggttgttgcggaacgccttccattccgactcgttcgagtgcgcgaggatgatcccgtcgaacggaatcgcgccgaaaccctcggtgcccttgaagttgccttcctgcgtggcggtgagcagcgggtgcaacaccttgatcggcgccttgaacatttcgacgaactcgagcaggccctggttcgccaggcacaggccgccggagtagctgtacgcgtcggcgtcgtcctgcgcgtactgttcgagcttgcggatatcgaccttgccgaccagcgacgagatgtcctggttgttctcgtcacccggctccgtcttcgcgatcccgatctgccgcaggatcgacggataacgacgcaccacgcggaactggcggatgtcgccgttgtattcgtgcaggcgcttgacggcccacggactcaggatgtttttcaggtagcggcgcggaatgccgtactgttcctcgaggatcgggccgtcttcgtcgtagtcgaacagcccgagcggcgattcgttgacgggcgaacccttcagcgaatagaacggcacgcgctccatcagttgcttcagacgctcggcgatcgacgacttgccgccgcccaccgggccaagcagatagaggatctgcttcttctcttcgagcccttgcgcagcgtgacggaaatatgcgaccacctgctcgatcacttcctccattccgtagaactcacggaacgcgggatagaccttgatgaccttgttcgcgaagatccgcgacaggcgcggatcgttgcgggtatcgatgtgttcaggttccccgattgctgccagcatgcgttcaccagccgtcgcgtacgcggatggatcgttcttgcagagcgcgagatactcctccagcgagagctcttcctctcgcgtttttcgaagcggttcgcgaagctgctgtaaatatccatgctacctccctcgcctgagtctgaagacgtgcctgccttcgtacgactgcgcagaagcaagcgcgttcgaattcatcctaaaccctttcttatttttttcacgaactcttcgtatgaagttcgtcattctcgacaacaccgcttggacaacgcatttcgtcgttttacaatcgacctcccgagccgcagaaactgcatccgtcgcgtctcgtcgaacaacggaacctcttgtgcgttggacacatccgacgtcgtcacttccccttcatccctatacgttcgagcagccgtttgcgacgacacgttgcgcgcgccgttacaaattttttcgcagcgcccttacggagatacccgtacgacggatgcgggaacttcactcgcacctgtgcgcaacttccgtcgatgcagatcgctcgatgcacgcaaccccgcacgatcgtcgttcatgtacgtcgtctgtcacatttctccgccgcagaaacgacgacgcccgcgtgttgcgggcgtcgttcgctaccaaatggggatagatgcgcggcacgcgcgaatcagaaggtttcccagtcgtccgcgccaccggtagcggccgcctgcgcgggcgcagcggcggccgcgacgggcttgcgcaccggcgccgccgcagccgcgcgtttcggcggggcatcgcgatcgtcgcgcgcagcagcgacaggcgcggcaaccgccgcggaagacgcacgcggcgcctgacgcaccgcaaccggtgccgcggcacccggccgcgacgtgtcgtcggcgagctggaataccgctgccgtttcacgcaggcgcccggcctgttcgtcgagcgactgcgcggcggccgcggcttcctcgacgagcgccgcgttctgctgcgtgacctcgtccatctgcgcgaccgcgcgcgccacctgatcgatcccgccgctctgctcctcggatgccgccgcaatctcgcccatgatgtccgtcacgcgctgcaccgcgccgatcacgtcgctcatcgtgcgccctgcctcgtcgaccagcgtggaacccgaccggacgcgctccacggacgcgtcgatcagcaccttgatctccttggccgcggccgacgaacgctgggccaggctgcgcacctcgcccgcgacgaccgcgaaaccgcggccttcctcgccggcccgcgcggcttccaccgctgcattcagcgcaagaatgttggtctggaacgcgattccctcgatgatcgcgatgatgtccgcgatcttcgccgagctgtcgttgatctcgcccatcgtgccgaccacctggccgaccaccgtattgcccttgtttgcaatctccgacgcattcgcggccagcgaactcgcctggcgtgcattgtctgcgttctgcttcacggtgccggtcagttgctccatgctcgacgcggtttcctgcagcgccgcggcctgctcctcggtgcgcgacgacaggtcgatgttgccggccgcaatctggcgcgccgcggtcgcgatcgactcgctgccgcctcgcacggtgcgcaccgtctcgacgagcccgcgctgcatcttgccgaggccctcgagaagctggcccatctcgtcacgccggtccacgacgatcggccggcgcaggtcgccggcggcaatcgcgtcgaaatgcgcgagcgcgtcggcaatcgggcggccgatcgcgcggctcagcgtcagccacgacgccaccgcggcggcgaagccggccgccagcgcgacgatcgccagcacacgcagcgtctcgtacaccgattccgcatgatcgaagttggcttgcgcgtcactgaactggtagttgcgcaacgcctcgctcgccgtcgagaggtcggtgtagcgcgcctggagctgctttgcgccgtcgccgatgcggtcggcctgattcgccccgagcacgctcgcgaacgcgtcgcactcgtgctgcaacgcctgccgcttcgcggcgacgtcctgtgcgatgcgatcctcctccgggccgcgcggcaacgcgagatacttttgccaccaggtgtccgactgcgcgcgcatcccgcggcttcgctcgatggcagccgccgcatcgggcgtgccggccaggagcgccgcccggtcgagggccaggcgttcgcgcgccgaatagatctcggcaagcgagacatcgaccgcgcttggcatctgattcttgaagatctcgcgcgtcgtgccgttcgcgcgcgtcattccatacacgccgagcccaccgatcacaccgaggagcaccgccagaaacgccatcgtgaaaccgatgcgcgcacgaatcgtcaggtttttgaacgccatcatccttcctgtgttgcgtcgtgatggacgggacggacccgtcgcttcgaagcattgcttcacttgatgcatttacgaccatgcatcgcacaacttgatggcgtttccgctatttttcgaattattcgtctgtttattacaaatagctgaacgaaaatacgtgcgtcgccgtgcactggcgtgcacatcgatggaaggccctccgtcgccggcgcgcatcacggatacgcggccggccgtcgtttgcgacgaaccggctgcgatgcgtgatcaggccctatccggccagttcggcaagcgtgggaatcgacggttgcgcgcccgcccgcgtgaccgacagtgccgccgcgcgttgcgcgaagcggatcgcggtgtcgacgtccgcgccggccgcgagccgcgcggaaaagccgccgatgaaggtatcgccggccgccgtcgtgtcgacggcctgcacggccggcgccggataatgccgcgcggcgccgtcggccgtcagcgcaagcacgccgcgcgcccccagcgtgaccagcacgttgcgcgcgccgccagcctgcagcgcgcgggcggcggcttccgcctccgccgggtcgcgcaccggcagcgcggtcaacgcggccgcctcgacctcgttcgggatcaggtaatcgacgagcggcagccagccgtccggcaacggcgcgacggccggtgccggattgagcaccaccgtgcggccgagccgacgtccggccgacagcgccgcgaacaccgcatccggcggcgtctcgagctggcagatcacgacgtcggccgacgccagcgcggcctcgtgccgcgcgaccgtatcggtcgtgacctcgccattgccgcccgcgacgatcacgatcgcgttctggctcgcatcgtcgacgacgatcagcgcgacgccggtcgacgccgacgcgctcgtcgcgagccccgcacagtcgattccctcggcttcgagacccgcacgcagtgccgcgccgtgcgcatccgcgccgacgcagccgatcatcgcgacctgcgcgccgagccgcgcggcagcgacggcctggttgccgcccttgccgcccgccgcctgcgcgaacgcatgaccggcgagcgtttcgccgggcagcggcaggcgcggcgcacgcacgacgagatccatgttgaggctgccgaccaccgtcacgcggccggcgcccgctgcgggcgccgtcatgcgcgaccgccggaagccggcggctcgcggtagatcgccgtcgattcacgcagcacgagacgcggcgacacgacgcgacggcggctcggcacggccgacgagccgccgccgatccgctcgatcagggtctgcgccgccatttctccgagcgcgcgcaccgactggccgaccgtcgacagcgccggataggtgtagcgggaaaattcgatgtcgtcgaatccgatgatcgaacagtcgtcgggcacgcgcatgccgcgctcggccgccgcacgcagcgcgccgacgcccatcaggtcgttgcccgcgaagatcgcgctcggccgcaccgattcgaacaaccgcgacgccgcgtgataaccgccgaggcacgagaagtcgctttccgcgatcgcgcccggcacgatgtcgacaccgcgctcggccatcgcacggatgaaaccgtgcacgcgcatcgcgctgaccgccgtgtcggtcggccccgtgatgcagccgatcttcgcgtgcccgagctcgagcaggtggcgcgtcgccaggtacgcgccgcgctcgtggtcgatctgcacgaggtcggccgcgagccctcgatgttgcgatcgacgacgacgagcggcgcatggatgtccgcaagcgtctgcgcgagcaccgcatcctcgcccgccgacgcgacgatcagcccgtcgatgcgcttttcctgcagcacgcgcaggtagttgcgctgcttcacgggatcgtcgtccgagttgcagaagaacacgcaatagccattggccgcgcactgatcctcgatgccgcgcgcaagttccgcgaagtacggattcgtgctgttcggcacgacgaggccgatggtcgccgtcgcacgcgccttcagcgagcgtgccacggccgacggcacgtaattcagctcgcggattgcgccctcgaccttcgcacgcacatccgcagacaccggccgcgagttgttcaccacgtgcgagacggtcaaacgacacgcccgccatggctgccacatccttgatcgtcgccatttcccgtttctctctggtctgttctgtctgtctttctaccgcacgcgcgtgcgccggctgcgatacgtatcgagcacgactgccaccacgatcaccgcgccggtgatgatccgtttcgtcggctcgttcgcgccgatctgcgccagccccgcggccagcaccgagatgatcaacacgccgaagaacgtgctgatcaccgagccgcgcccgcccatcaggctcgtgccgccgatcacgacggccgcgatcacctgcagttcgaggccgacgcccgcgttcgggtcggccgcctcgagccgcgaaatctggaacagcgacgcgagccccgcgagcgcgcccatcagcgcgaatacgagaattttatacggcctcggttaaccccggcaagtcggacggcttcttcgttcgtgccgatcccgacgagatagcgtccgaacacggtgcgcgtcagcacgaactgggccgcgatcatcaccgcgaccgcgatcaggaacgccggcgagatgccgagcgcgatcgggttcgacaggaaatcgaacgcgtcgccgatataggcggtgcgcgaattcgtcagctggtacgcgaggccgcgtgcggcctccagcacgccgagcgacacgatgaacgacggaatccgccagccgaccgtgaccgcgcccgtcagcgcccccgtgacggtcgcgaccgcgatgccgatcagcgcggccggcagcggccccactgccatttcagcgcggcgacgctgaccatcgacgcggcgagcgcgagcaccgagccgaccgacaggtcgatcccggcgatgatcagcacgaaggtcatcccgaccgacatcacgacgagatcgggaatctggttcgcgatcgtgctgaacgtatcgtaggtcaggaaatgcgagctcagcgtcgaaaacagcacgatcatcgcggcaagcgcgccggcgagcccgagatagttcgacaggccgagccgcgtgccggacagcgtgcgcgcgcggcgccccgtcacgtcctgctgcgcgcctgcgtcggtcggggatacgggaggctgggtcattgctgtcgtcctgtcgtcgaagtgcccggagcggcgccttgcgcctgccccgcgtccggatgccgagcgccgtccggcggcgtctcgcggccgaagccggcgaacgccgcggccagcagtgcatcctgggtccagttgccgcgctcgaacacggcggtcatgcgcccggccgacatcacgccgatccggtcgcagatcagcatcagctcacgcaggtcgctcgacacgacgacgagcgcgcggccttcgcgcgcgagcgcgcccatcaaagtgtagatctcgaacttcgcgccgacgtcgatcccgcgcgtcggctcgtcgaacagcagcacgcccatgtcgcgcgcgagccagcggccgatcacgaccttctgctgattaccgcccgacagctcgccgaccgcctgcgccgcaccgtgcgtgcggattcgcagcgcgtcgatctgctgctcggcgagcgccgtttcacgcgcgctgtcgacgataccgccgcgcgccagccggtcgagctggccgagcgacacgttcgcggtgatcgactgcgtgagcagcaacccttcgcccttgcgatcctcggtgatcagcgcaatgccgtgcttcaccgcctcgacgggcgagccgatccgcaccggcttcggcggctggccgatcgcgatcgttcccgcatccggcgcatccgcgccgtagatcagccgcagcagttcggtacgtcccgcgccgatcagccccgagatgccgaagatctcgcccgcgcgcacctcgagcgacacgtcgcgcaccgccgtcccgcgggcgaggcccgacacgacgagccgcggtgcgccgatacggcgctcgccgagatcgatgtgctcgccgatctcgcgcccgaccatcagcgtgacgagcccgtcggacgtcgtcgccgccatgtcgcccgcatggacgagccggccgtcgcgcagtaccgcgacccgctcggcgacacgcgcgagctcctcgagccggtgcgagatgtagatgatcgcgaccccgcgtgccttcagccggtcgatctgctcgaacagcagctcgacttcacgcgcggtcagcatcgcggtcggttcgtcgagaatcagcacgcggcagtcgccgatcaggttgcgcgcgatctcgaccatctgctgatggccgatgccgagcgcgcccaccggcgtatcgggatcgaccgtgtcgagcccgacctgggccatcgcggcccgcgcgtcgtcgcgcaaccgcgcgcggtcgatgatcccgaagcgccgcggcaggcggttcaggaacaggttttcggcgaccgtcagggtcggcagcaggttcagctcctgcatcaccatgcgcacgccgagcgcctcggcctgcgtccggctcgccggcgcatagggctggccgcccagctgcatcgtgccggcggtcggctcgacgagcccgccgatgatcttcgacagcgtgctcttgccggcgccgttctcgcccgtcaacgcaagcgcgtggcccgcctcgagcgtcagcgtgacctcggcgagcacgggttcggcataggtcttgccgatgccggatacggacagcacggagcggctgcgcgggagggttgggaagtcgggtccatcgcgatcctgattgcggccgcgcgcacgcggcgcgcgggtatgacgctcacaagtgcatgtgcatgcagtggccgtgatcgcgctcacccctgataacggccgccgcgcccgattcttgagggcggcggccgtatcggggttgcgtcacttcgtcacgagatccaccggcgtctcgaccacgcccgacatgtcggcctgcttgcgatgctcggagatcgccttgagcgccgtgtcgatgccgaacacggcctgcttcgccgcgtactgatcggccgtcgcgagcacgcggccgtccttcagcatcggcttgatcgcgttgatgttgtcgtagccgaccacgaacaccttgccctgcttgccggccgcgcgcacggccgacacggcgccgatcgccatgttgtcgttgccgcacagcagcgccttcaggttcgggtattcgttgagcatcgcggccgcgaccgcattgcccttgtcgatctcccattcaccggactgcaccgatacgaccttcatcccgcccgccttcatcgcatcctcgaagccggccgtgcgctgctgcgcattggtcgtcgtcgacacgccctcgacgatgccgacctggtcgcccgccttcagccgcttcgcgaggtaatcgccgatcttgcgcgcgcccttgcggttgtccgggccgacgaacggtacgttcaggttcttcgatttgagcacgtcgggatcgagccggttgtcgatgttcacgacgatgatgccggcgtcgaccgccttcttcacgaccggcacgagcgccttcgaatcggccggcgcgagcacgatcgcgtcgaccttcgacacgatcatctgctcgacgatgcggatctggttcgcggtgtcggtctcgtccttgatgccgttggtgatcaggtcgaactggttcgcgttgtgcttctggtattccttcgcgcccgtttccatcgtcaggaagaactcgttggcgagcgacttcatcacgagcgcgaccttcggcttggccgatgattgcgcgtggacggccggtgcggcggcaaccgcgacggcggcgagcgcggcggtcaggaagcgacggcgaaagaggacattcatacacatctcctggcgaccggccccaagggccggactattgtttgactgttgttttaatgtgagcaaacgtttgcgccacactacccgggcaatggccatcgatgctgctgtcggtaccacggaatggaagcgaggcagacggccgactgcctgacgcgtgctgttgtttacgcgccgccgccggcggaagccggcggagtgaaggctatgctgtaccgattcgcgtcggcgcgcaacctgtctgatcaatatttaagggtttattcggagcgcgtgtcacgccggatcccgcggcgccggctcgtcttcatcggctgacggcggctcgccgaagcggttcgcatgcggcgtgccggcgatgaagccgttcatcacgaacaacgcgagcgcgccgacgatcggcacgaacaccaacagcatccaccatcccgacttgtcgatgtcgtgcagccgcttcacaccgaccgcaatcgacgaccacgccgcgacgacggcgaccacgatgagcaccagcatcgccagcagcggcagatcgtcatccggcgagcggtgcgaatccgcatcgaaaaacacgctgagcaacgcggaaaccagtgcgtagatccaccacggcaggcgtccgatccggccttcgaaggaaaagagaaaccatttcaggttcattgtttacctcgtcgtcacgcgtgttgcgtgctgtgcgccatgctgcccaatgtgtccgaacgggcaatccgcgtgcggtgtgttgcgaatgcgaacgggctgtcggtcatgtgccccgcgcttcgttccggcgtcgcgcagggtgtcgttgaagcgggccggccggtcgggatggtgccggagagtcgcggcaacacccgtcagccggtattcacgcgcattgaatcacagacaaggagaaacggggcggccggtatgcaggatggcaaggcccgatgcgaggcgctcgaacgtgccgtcttgatttctcgctggcaggcgagcgcatgtcgtgcgccgggtgcggggatgaatcggcgggaaaccgcgattgcggccggtgattcggtgagtctgggtcgaacaaccagacggcggcagatcgcctgccgccgcctggtgcatgacgggacgtcgcgccatccgcgttgatcgcgcggacggcgcacgacgtactgtcgtcaaacggcttcgcgcaacagccccgcgatttccgcttcgttcaggtgcggcgcgaacatctcgatcagccggtacgcatacgcacgcaggaatgcgcccttgcgcaagccgacccgcgtcgtgctcgcctcgaacaggtgctgcgtatcgagcgcgacgagccccgtgtcgcgctgcggatcgtaggccatcgccgcgacgacgccgatccccatcccgagctcgacataggtcttgatcacgtcggcgtcgatcgcggtcagcacgacgtcgggcacggcacccgcctgcgtgaatgcctgatcgatgtgcgagcggcccgtgaagtcctggtcgtacgtgatgatcgggtactcggcgatttcctcgagcgtcaggttctcgcgaccgacgagcggatggcccttcggcacgacgaccgtgtggtgccacgaatagcatgggaacgtgacgatgtccggatagcggtcgagcgcttcggtcgagatgccgagatcggcctcgccgttcaggatcatctgcgcgatctgctgcgggctgccctggcgcagcgcgagatggaccttcgggaacacgtcggtaaactgccggatcaccttcggcagcgcgtagcgcgcctgcgtgtgcgtcgtcgcgacgacgaggtggccgctgtcctggtctgcgaactggcgcgcgacgcggcgcaggttctcggcatcgagcagcatccgctcgatcagctggtgcacggccttgccgggctccgtgagccccgtcagccgcttgccgcgccggatgaagatatcgacgcccagttcatcctcgagatccttgatctgcttggacacgccggactgcgacgtgtacagcacgttcgcgacttccgtcaggttcatgttctggcgcaccgcttcgcgcacgaaccgcaattgctgaaaattcatgggtatgcctcttaggctgtcgttgtttgattgtctgatcggagcgcgctccgcccctgccctgcattctggcgtcaacgcgcgggaaacacacgcaccgcgcgcggcacggccgtcgcaccgtcgccgacctgcagcgacagcgcacgccatgcgtcgcgatcgagttccgcctcgagcgcgccgcccgcgcgcgcctcgagctccacgcgcaccgaaccgccgagcggaatcacgcggcgcacgtccaccgcgatgccgtcgcggtgcccctcaccggccggccagagctgcaggtcgtgcggccgcacgtacgcgttcgcagggcccgcgaaatcggcgtcgacctcgatcggcgcagccgcgccctcggccacgaagccgcgcccggcgaccgtgcccggcagccggttggccgcgccgaggaactcgtagacgaacgcgctctgcggatgatcgtagacgtcctgcgggctgccgacctgctcgacgtggccgcggttcagcacgacgatgcggtccgcgacctccagcgcctcctcctggtcgtgcgtgacgaagatcgtcgagatgtgcaggtcgtcgtgcagacggcgcagccagccgcgcagttccttgcggaccttcgcgtcgagcgcgccgaacggctcgtcgagcagcagcaccttcggctcgaccgcgagcgcgcgggcgagcgcgatgcgctggcgctggccgcccgacagctccgacggataacgctgcgcaagccagtcgagctgcacgagcttcagcagctcgtgcaccttgtcgcggatcgcgctttccgacggccgctcgcggcgcggcttcacgcgcagcccgaacgcgacgttctcgaacacggtcatgtggcggaacagcgcgtagtgctggaacacgaacccgacctgccgatcgcgcgcgccgaccgacgcgacgtcgagccctgcagcacgacctggccggcgtccgcgtgctcgaggcccgcgatcacgcgcagcagcgtggtcttgccgcagccggacggcccgagcagcgcgaccagttcgccgggcgggaagtcgagcgacacgttgtcgagcgccgtgaaatcgccgaagcgcttctgaaggttacggacggtgatacccattctggttgcctctttacgatttcgacgaaacggcggcggggccggcgtgtgcgggaacggtgtcgctcgcgccggccagttcggcggcgagatgacgctcggcgatcagtttcagggcgagcgtgacgagcgcgagcagcgcgagcaccgacgccaccgcgaacgctgccgcgaagttgtactcgttgtacaagatctcgacgtgcagaggcatcgtgtcggtcacgccgcggatgtggcccgatacgaccgacaccgcgccgaactcgcccatcgcacgcgcgttgcacaggatcacgccgtacagcagaccccacttcacgttcggcagcgtcacgcggcggaagatctgccagcccgacgcgccgagcacgcgcgcggcttcttcctcgtcggtgccttgcgcctgcatcagcggaatcagctcgcgcgcgacgaacgggaacgtgacgaagatcgtcgcgagcacgatgcccggcaccgcgaagatgatctgcacgtcgtgcgcctgcagccacggcccgagccagccttgcgcaccgaacagcagcacgtacacgagacccgagatcaccggcgacaccgagaacggcaggtcgatcagcgtcgtcagcagcgccttgccgcggaattcgaatttcgcgatcgcccacgacgcgcacacgccgaacacgaggttcagcggtacggcgatcacggcgacggtcagcgtcagcttgatcgccgaccacgcgtcgggatcggccagcgattcgagatagaagccgacgccttttctcagcgcctcgacgaacaccgcggcgagcggcacgacgaggaagaacgcaaggaacgccagcgcgatgcccgtgagcagccagcgcacgacgcgcgactcgctgacggggtcgagccgcttcgcggcgcgcccttgctcggccgaagacggggttttcagcacgacggtggcctcctggctcattgctggcctcctgctgcggcggcggtgacggtagcaggcgcgggaccgctcgcacccttgctcgtgcggcgctgcagataccactgcagcgtgttgatcagcagcagcatcaggaacgacacgacgagcatcacgaccgccagcgcggtcgcgcccgcgtagtcgtactgctcgagcttcgtgatgatgagcagcgacgtgatctcggatttcatcggcacgttgccggcaatgaagatcaccgagccgtattcaccgagcgcacgcgcgaacgcgagcgcgaacccggtgaggagcgccggcagcacggccggcagcacgacgcggcggaacgtcagccagcgcgacgcgcccaggcacgcggccgcctcttcctgctcgcgctcgaaatcctcgagcaccggctgcacggtgcgcacgacgaacggcagcccgatgaaggtcagcgcgaccagcacgccggccggcgtgaacgcgatcttgatgccgagcggcgcgagatactggccgacccagccgttggtcgcatagacggccgcgagcgagatgccggcaaccgacgtcggcagcgcgaacggcaggtcgacgatcgcatcgacgaggcgcttgaacgggaacgtgtagcgcacgagcacccacgcgacgaggaagccgaacacggcgttgatcagcgcgccgccgagtgcggacgtgaacgtcagccggtacgacgcgagcacgcgcggcgacgcgacggcggtgacgaactggtcccacgacagcgtcgcggtcttcaggaacgtggcggcgagcggtatcagcaccacgaggctcaaataggccaccgtgatgcctagcgtcacgccgaaaccgggcagcgcgctcggcttgcgaaaggtgtacgtcgtcatcggatgctcttgctgggtcgatgctgctcatgggtccgacgcaaacgccggcgcgatgctttgcgccggcggcccgccgagggtgcggcgcgctgtcgtggcgcgccgctgtcgttatggtgttactgcggcttgtagatcgaatcgaacacgccgccatccgcgaaatgcgtcttctgcgcattcgtccagccgccgaaggtatcgtcgaccgtgtacagcttcagcttcgggaactgcttggtcagctccgccggcacgttcttcgaacgcggccggtagtagttgcgtgccgcgatctcctggccctgcgggctgtacaggaagttcaggtacgcatcggccagcttgcgcgtgcccttcttgtcgacgaccttgtcgaccaccgcgacgggcggctcggccaggatgctcaccgacggcacgacgatctcgaacttgtcggtaccgaattccttgaccgacaggaacgcctcgttttcccatgcgatcagcacgtcgccgatcccgcgctgcacgaagctcgtggtcgcgccgcgtgcgcccgaatcgagcacgcccgcgttcttgtagagcttcgtgacgaattccttcgccgtctgctcgttgccgcccggcttgtgcaccgcatacgcccatgcggccaggtagttccagcgtgcgccgcccgacgtcttcgggttcggcgtgacgatcgagatgcccggcttggtcaggtcgtcccagtccttgatccccttcgggttgcccttgcgcaccaggaacacgatcgtcgacgtatacggcgacgcgttgtcgggcaggcgcttctgccaatccttgttgacgaggcccttgttcgcgagcgcgtcgatgtcgtacgccaatgccagcgtgacgacgtcggcctgcaggccgtcgagcaccgagcgcgcctgcgcgcccgaaccgccgtgcgactgcttgaagttgacggtctcgcccgtcttcgccttccactccttgccgaacgcctggttgaagtcctgatacagctcgcgcgtcgggtcgtacgacacgttcaggaaggtcgtatcggcctgggcgtgcgtcgcgacgcccagcgccgccgccgcgcccagcgcgagtgttgcgatcaggcggcccactccgcccaccagccccgtattgcgcttgcccatccttggttctccagtgttgtcggtattgcgatgtcgggccagtctagcgaacgggttacatgattaaaaataatcgttcctcatttttaatactcaaaagtgctaacgcagacgggatggacggttgtggcagatgaaccggcgtccggacgtcgcaaaatcacgtcggaaccggcgtgatcgcgtcgaacctcacgtaacacttgaaattcgcgaactactgtataaaaatacagctcactgtctatccatacagttgagccatgaccaaactcaccgcccgtcagcagcaagtgttcgacttgatccgtcgcgcgatcgagcgctccggattcccgcccacccgtgccgagatcgcggccgaactgggcttcagctcgccgaatgcggccgaagagcatctgcgcgcgctggcgcgcaagggtgtgatcgagctggccgccggcgcgtcgcgcggcatccgcctgctcggcatcgacgatgccccgcaccagttcacgctcccgcacgccggcctgatgcagctgtcgctgccgctcgtcggccgtgtggcagccggtagcccgatcctcgcgcaggagcacatctcgcagcattacgcgtgcgatcccgcgctgttcaccagcaagcccgactacctgttgaaagtgcgcggcctgtcgatgcgcgacgccggcatcctcgatggcgacctgctcgccgtgcagaagcgcacggaagcgaaggacggccagatcatcgtcgcgcgtctcggcgacgacgtcacggtcaagcgcctgatgcgccggccgggcggtctcgagctgatcgcggagaacccggattacgaaaacatcttcgtcaaggccggcagcgcggaattcgcgctggaaggcatcgccgtcgggctgatccgctcgggcgaactctgacattccgtctcgctgaggagaacatcatggaacgccttgcccgcctgctgcctttccgtcaattcggtcgcctgcgtcacctgcgcggccgcacgccctgcgcaccgctgtccgcggcggcgcctgtgcaagaagaagtcgcagtcgaacggcaggcgtccctgctgccgtcggcgctccccgctttcgcgcgggtatcgctgaacgccggcctgaatcacgcggaacccgcgcgtcgcgcgccggtgcgcgtctatcacggtcgttcacgcctgatcatggtcggcacgatcgatgccgtgtgccggatgatcgatcgctgcattgcagaggaacgatcggccacgcctggcggtctctgattgcggaacatccccgcaccggaggcaacgtgaccggatcttcgggccgcgcatggcggctcaaacccctgctgatcatcgtgctggccatcgccgccgttgcggcgatcggctatgcctacgcgtcgccgtacgtcgcgctcggccgcctgaaaacggcgatcgatgcgcgcgatgcgcaggccatcagtgaatacgtcgattttccgtcgctgcgcatcagcctgaagcagcaggtcacggaagagctgatgcgccggatcgacgcggtgaagaagagcaatccattcgcggtgctcggtgcactgatcgggtcggcattgatcggcccgctggtcgatgcatacgcgaccccggagggtgtggccgcgctgatgagcggattgccaccgcgtggcaatccggggagcgtccacctgacttgtcgaatctgccaccaggcagcgatgcgccgggcaacacgccggccgcaccgacgcccaatcaggcttcggcaagcgcagccgctccgggcagcaacgcggcagccgcatcatcgccgccccctgctgctgccgcgccggccagcccggtcgaagcaccgcattcgccgcatcagcagcaaaccagcgccggctaccggaatatcgatgaattcgtcgtgacctaccagcgcagtgccgacggcacgcgctatgcggcgatattccaccgcttcggcctgttctcgtggaagttgtccgcaatcgacctgcacgcttgacagggcccgacaggacttgactggctcggggtcgtcgcccgagccactgaggcggcgtgactgcccgaccggcacggttcgccagtcaggcagtcatcgaatcattggatcatttgccgttcgccgtggccgcttcacgctcgcgtgcgatttcggccttctgctcttgcgccgacgaacacgcaaccaggatgctgcagttcacgcgatcgagcagttgtgtgttgcccgagcccatccaccatctcgacagcccgctgcggcaccggtggccgacgacgacgagatcggcgttcagttccgtcgcgagattcgcgatttcgtcgatcggatagccgaatgcgaaatggccttcggcctgcacgccgcgctcgcgcagccagttcaccccttcctgcaggatttcacgcgcggtttcctcgaaccggccgcacgcgacgtcggtcagcaaacccgcgctctgtgcaatgctcgagcgcatgtcgacgaccgacagcaaatgcgtctcggccttcaggtccatcgcgagattggcgccgcagcgcagtgccttgcgcccttcgagcgtgccgtcgtaacacagcagaatcttgttgtagctagccatgaaacctccctatcgcaacaacgagcctacgcattcatcatggtgcgccgcaattcaggacgcaagggatggaaaacgctgattcgccccgctcggcgcgtgcgcgatgatgcggtgcacgatcggtgcgcgcatgcatcgcaccgcgcaggcatgccctgaagagacgcagccgatgcactagaatggcccgttcgtactccagcgggccaccaggcgccggcgtcgtgcgcttcggtcatgcccgtgtgacaggcaatcgtccgatcggttcgccaaccggccatgcatccggcagcgaaacgctgccgcgcccgcatacaacgacaacacacccatgctcgttgcaccgatcgatttccggaacgtcgaaagcgctatggcgacaagctcgtcgtcaacggcctgtcgttcactgtgcaggccggcgaatgctacggcctgctcggccccaacggcgcgggcaagaccaccacgctgaaaatgctgctcggcctcacgcaccccgatgcaggcaccatttcgctctgcggcgaaccggttccatcgcgtgcgcggcatgcgcgccagcgtgtcggggtcgtcccgcagttcgacaatctcgaccccgacttcaccgtgcgcgagaacctgctcgtcttcagccgctatttcggcatgtcggcgcaggctgcgcacgcgctcgtgaaacccctgctcgaattcgcgaagctcgagaacaaggccgatgcgaaggtcggcgagctgtcgggcggcatgaagcgccggctcacgctcgcccgtgcgctcgtcaacgatcccgatgtgctggtgctcgacgagccgacgacgggcctcgacccgcaggcacgccacctcatgtgggaacgcctgcgctcgctgctcgctcgaggcaagacgatcctgatcaccacgcacttcatggaagaagccgagcgcctgtgcgaccggctgtgtgtgatcgaggaaggccgcaagatcgccgaaggagcgccgcacgcgctgatcgaatcggagatcggctgcgacgtgatcgagatctacgggcccgatccggccacgctgcgcgacgagctggcggcgttcgcgaagcacaccgagatcagcggcgagacgctgttctgctacgtgagcgacccggaaccgctcagtgcgcgactcaagggtcgcacggggttgcgctatctgcatcgcccggccaatctggaagatgtgttcctgcggctcacgggccgcgaaatgcaggactgatcgatcatggacgtgcgcaactattccgccaccgccccgtcggcaccgccgcgcgtgtcacgcttcgcgatcgcgatgcccgcgaacgcaaccaactggatcgccgtctggcggcgcaactatctcgtctggcgcaagctcgcgctcgcgtcgatgttcggcaatcttgccgatccgatgatctatctgttcggtctggggttcgggctcggcctgatgctcggccatgtcgacggcgtatcgtatatcgcgttcctcgcggccggtacggtcggctcgagcgtgatgatgtccgcgagcttcgagtcgatgtattcgggtttctcgcggatgcacgtgcagcgcacgtgggaagcgatcatgcatacgccgcttgcgctcggcgacatcgtgctcggcgagatcgtctgggggccagcaaggcgatgctgtcgggggccgcgatcatgctcgtcgcgggggcgctcggttatgcgcagtttccgtcgatgctcgcggcgctgcccgtgatcgcgctcgcgggcctcgcgttcgcaagcgtcgcgatgatcgtcacggcgctcgcaccgtcctacgatttcttcatgttttatcagacgctcgtgctgacgccgatgctgctgctgtcgggcgtgttcttcccgaccacgcagctgccgccgatcgcgcggcacgcggcgcaggcactgccgctcgcgaacgccgtggagctgatccggcccgcgatgctcggccggccggcgaccgacgtcgcgctgcatgtcgcggtgctcgccggctacgcgatcggcgggttcctgctgtccgcctggctgttccggcggcggatgatgcgctgacggccggcgcaccgggcgccggcttcatgcgacgacgttactcgtcgtcgtcgctccacgggatctcgacgtcggtcaggaacgcgacggtcgcgagcgggccaccttcctggcggccgagcttgccgtccgcgcgatgccattcgacgcggaactgcgtgcccggatcgtcggcgaccagataaaccgagcgcagctcttccttgtcggcctcgtccaccgggccgtcgaacgacaccagcatcttctgcggccacaggccgttgaccggatcgtaaatgcggtcgccttgcggaatgtcgatgctggcctcgacgccgatcgttgcggaggcctcgatgatcatcgtgccgagtgcgttcagcacggcagtcgcccgcgcggaattggcctggcggatcgcgagatcgccgcgcgtcagcgccttttcgagtcgaggatgaatcttcggttgggtcatgcgttttcctgtttgcttcttgtaaatggcgccgcacgcgtgaaacggcggcgccggatgaatacgacgattgcgcccggccggcgcaccgcttgcgcgcgtcagaacccgagcgcgaccgcgagcaggccgctcgcgatcccgaacacgacgacgaggatcgcgacgatggccagcatgtaaggcttgaacgaacgcgcgagcatcgcgagcgacggcacgctgatcggcggcagcgtcatcagcagcgcggcggccgggccgacgcccatgccgagcgacagcatcgcctggatgatcggcacctcgcccgccgtcgggatcacgaacagcatgcccgcgaccgcgaaggcgatgatccagccgagatgattgccgatgtccgggccgatatgcgggaacagccatgcgcgcgcggcgccgagcagcagcacgagcacgatgtattcgggcacgagccgcacggccatgcgcgcgagcagcttcatccagcggacgaacggattgccggccgcggcctgctcggccgccagcgcggcgagctgcgcatcgtcgatgcgggcgtcttcagggcgcgcgatccggttcagcagataaccgatcccgaataccatcgcgacgcccagcacgaggcgcagcgcactccagtgccagccgagcacgaagcccatgaaaaccagcgccgccgggttcagcaccgtgttgccgagccagaacgcgaccgcgccgcccggcgaggcatggcgtgcacgcagccccgcgacgaccggcgccgcgcagcacgtgcacatcatgccgggcagcgacagcaggccgcccgcggcgacgctgccgaagccggtgcggccgagcacgcgcgcgacccagtgcgcgggcagcagcgcctgcacggccgaaccgagcagcaagccgagcaccatcgcctgccagatcgccttgccgtacgcccatgcgtagtcgagcgcggccttcagcgacggctcgggcgcggccgccgacgtgcccatcaggatcgactgtccgatcgaatgatgctcggcggcaacgaacgccttgttgtagtacgggaaccatttcacatagaacagccccgcgaccgcgatcagcaggaaggtcatccagccgagtgccggattgggttgggtgcgtgtggtcgtcatcgtgtgatcgtcgattggtttttgtcggtggcgggcttcacgcctgccgcaagcgcggccgacgcgggcagcccggcctgcgcgagttgcgccagcagcgtgcgcgcctggtcgcacgcatcggccgcgttgggccggaaggtgaacgtcagcgcccggttcggcttgttgtacgtcgcgcgataagtgcgtgcataggcgggatcgtaatgcttgtcgatcagttcggtgaacagttcggcacgcgcgccggcatcgatcagcgccttccagtgcgtcacctgttcgcggctgtgcaggccgatcagccggtgcagctgtgccttgaacgcgtccggttcgtcgaacaggtgcgcgtaatcgtcgaggaggaacgcgatgcgctcgtcgtgcgccgcgtcgacatgcacccacggccctgcgtgaaacgcttcgatcaacgcgatcggcaactgcacgagcccgatcctgcggctttccgactcgacaaataccggccattcggggtcgaaacgcccaagtgtttcgacgagccccgaatcgaaccccttctgcgccggctgcggcttgcccggcagcgcgccgagcagcgaaccgcgatggcacgcgagcgcctcgagatcgagcgtctgcgcgcccgcgtcgcgcagcgcgttcagcaggcgcgtcttgccgcagcccgtatggccgacgagcgcgatgtagcgaaagcgcgtcggcagcgagtcgagcgtcgcgcacaccgactggcggtatgacttgtagccgccgtcgagctggcgcgccttccagccgatcaggttgaaccaggtcgtcatcgagcccgagcgcttgccgccgcgccagcagtagatcagcggccgccagttgcgcggccggtcggcgaacgtcgtgtcgagatgacgcgcgatgttgcgtgccaccatcgccgcgccgacgcgcgtcgcctcgtacggcgacacctgccggtacatcgtgccgacgagcacgcgctcctcgttgctgagcacgggcgcgttcagcgcgccggggatatgatcctcggcgaactcgagcggcgtgcgcacgtcgatgatctcgtcgaactcgccggcgcgatcgagggtgacaatcaggttcttcaatttggcgtcgaacagggcgatgcggctcgatgagccgcatgggcacggaaggcggattggcgattatctcacgggccggcgtctcgggccgcgcgcggcggccggcggcggcgatgcggcctgcatcgcgtcgatcagatggtcgcggaacgcgcgaaccgatgcgggcagatcgcgccccgccatcgtctgtatctggatgctgcgctcgcgcaactgcgggttcgtcacgggcacgacgacgaagccgtccgcggcgcagcggtcgcgcaccgacagcagccccgtgaacatcaccgcgcccgtgcgccgcgcataaccgtacatcgccgccgtgttgttgctcgtcagttcaggctcgagcagcagcccgtcgagcgcgcatgcgatgtcgatcagctggcgcaccgtggtgccggcctcgggcagcacgtgcgggtgacgcgcgacatcggcgagcgacaccgcttcacgcgtcgcgagcggatggtcacgtcgcaccagcgcgaagatcggcgcgcgctcggtatgctcgacgcgcacgcccttctccggcgcgaggctgaagctcaacgcgatgtccacgtcgccgtcgcgcacgcgccgcgtcgcgtccgccggcgacacgacccacaccgagaaatcgacgcccggatggcgcgccttgaagcgtgcgagcgtgccgggcaggaaatcgatcgcgaacccttccgagcaggcgatcttcagcaggctgccgtgcagcgcgtcgagcccgccgatgtccttcatcacgtgctcggcctccagcaggctgcgctgcgcgaacgccagaagccgctcgccggcctccgacagcgccatcccgcgcggccggcgctcgaacagcggtgcgccgagctcgctctcgagtttcgcgatctggcggctgatcgccgagacagccacgtgcagccgcgcggacgcgtcgctgatcgaaccggtgcgcgccacctcgacgaaataccgcaacgccaggccatgcaggaaagccgccatcgttctgtctccacccggctgccggccgcgctgctttgccttttcggcaaagaaaggttcgaaattcgatcattgtgacaaaaacggctttctagaatcgatcgcacttcacgctgcacgcacgatccgcggcgtgcagcgaacccgacacaggagacacgacttgagccgtaccgccgccatccagcacgcgctgaaccagttcgaatccggtgcgttcttcacgaccctgagccgccgtgtcggcttgcgaaccgaaagccaggagagcggcacggtgccgcgctgcgcgcctacctgaccgacgagatcgcacccgaggctgcgcgcctcggcttcacgtcgcggatcgtcgacaacccagtcgacggcggcggcccgttcctgctcgcatcgcgccacgaagacgatgcactgccgaccgtgctgatctacggccacggcgacgtcgtacgcggctacgacgcgcagtggcgcgcaccgctgtcgccgtggacgctgacggccgacggcgaccgctggtacggccgcggcagcgccgacaacaaaggccagcacaccatcaacctggccgcactggcgagcgtgctcgatgcgcgcggcggccggatgggcttcaacgcgaagctgctgatcgagatgggcgaggaaacgggttcgccgggcctcgacgcattgtgccgtcaggagcgcgatgcgctcgcggccgacgtgctgatcgcgtccgacggcccgcgcatcgcggccgcgcgccccacggtgttcctcggctcgcgcggctcggtcaatttcaagctgagcctgcgcgcccgtgacggcgcgcatcactccggcaactggggcgggctgctgcgcaatccggcgatcgtgctcgcgcacgcactcgcgagcctcgtcgacgcgcgcggcgcgattcgcgtcgcggggctgcgtccgccgccgatcccggccgccgtgcgcgaggcgctcgccgatctctgcgtcggcggcggccccggcgatccggcgctcgacgccggctggggcgagcccggccttaccgcgcccgagcgcgtgttcggctggaacacgttcgagatcctcgcattcaaggccggcaaccccgagcaccccgtcaatgcgatcccgcccgccgcgtatgcgcactgccagttgcgcttcgtcgtcggcaccgactggcaggcgctgcatgcgcacctgcgcacgcacctcgatgcgcacggcttcgccgacatcgagatcgacgtcgagcgcggtgcaccggcgacgcgcgtgtcgccggacgatccgtgggtccgctgggcggtcgcgtcgctggcgcggaccaccggcaagaaacccgcgatcctgccgaatctcggcggcacgctgccgaacgaagtgttcgccgacacgctcgggctgccgaccctgtgggtaccccattcgtaccccgcgtgctcgcagcacgcgcccgacgagcacctgctcgcgagcgtcgtcagtgagggcctgcagatgatggccggcctcttctgggatctcggcgaggacgccccgaccgttcgccgcgcggcgcccgccgcggccggcgccaccctgtaacgcgcttcgcccctttcacgggatctgcccacacgatgaacacgaccaccctgacctcgcaggaagccgcccaccccagcgccgcgaagatccggcgcatcatcttcgcggcgtcgatcggcaacgcactcgaatggttcgacctgatcgtctacggcttcttcgcggtgacgatcgccaagctgttcttcccgccacgagcgaagcgacgtcgctgatgctcacgctcggcacgttcggcctgtcctacctgatccggccgatcggcggcttcgtgctcggcgcgtacgcggatcgcgcgggccgcaaggcgtcgctgctgctgtcgatcgcgatgatgatggccggcacgctactgatcgcgtcgatgccgacctatgcatcgatcggcatacttgcgccgctcgggatcatgttgtcgcggctgatgcagggcttttccgcgggcggcgaattcgcgagctcgaccgcgttcctcgtcgagcacgcgccgcagcggcgcggtttcatgtcgagctggcagttcgcgagccagggcctcgcgacgctgctcgcgtcgggcttcggtgcgctgctgacgtccacgctgacaaccgcgcaactcgaaagctggggctggcgcgtgccgttcctgttcgggctcgcgatcggcccggtcgggctgtacatccgccgttacgtcgacgaaggcgtcgagttcaagacgcaggcacgctcggaagcgcccgtgcgcgaactgttcgcggatcagaagctgcggctgctgctgtcgatcggcgcactcgtgatctcgaccgcgatcaactacatggtgctgtacatgccgacctatgcgatcaagcagctcggcctgcccgcgtcgacgggcttcgcggcgacgctcgcgaccggtttcgtactcacgctcgtcacgccggtcgtcggccacctgtccgatcgcacggggcggatccgcatgatggcggccgcggccctgctgatgctcgtcagcgtgtggccgacgttcgcctggctcacgcgccacgcgtcgttcgcaacgatgctcgccgcactggtctggatcggcgcgctgaaggcgatgtactgcggcgcgctgccggcgctgatggccgagctgttcccgtcgcagacgcgcgcaacggggctcgcggtcagctacaacacggggtcacgctgttcggcggcttcgcgccgttcgtcatcacctggctgatcagcgcgaccggcaaccggctgtcgccggcgctctacctgatggggtgtgcggtgctgagcctcgtcgcgctgttcgtcgcgcgcacccggctcaagatgcgataacggaagaaacgacggcgcggcgacgcgccgccggtgcggcccggcgcggcatcgtcgccgcgcgggccgcgcgccgtttacggcgccgggttcggccgcagctcgtgcagcgcgtcgatctcggcgaggatctcgtcggacagcttcacgtcgacgctgccgatgttctccttcaactgctcgagcgacgtcgcgccgaccaggttgctgcgcacgaacggccggctgttgacgaacgccagcgcgagctgcgcgggcgacagcccgtgacgccgcgcgagcgcgacatagcgcgacgtcgcctcgacggcctgcggcttgctgtagcgctggaaacgctcgaacagcgtgatgcgcgcaccggccggacgcgcaccgttctcgtacttgccggacagccagccgaacgcgagcggcgaatacgcgagcaggccgacgccgtcacgatgcgtgaactccgacagcccgttctcgaacgtgcgattcaccaggctgtacggattctggatgcttgcgatgcgcggcagcccgagcttctcggccgcgcgcaggaactgcgcgacgccccatggcgtttcgttcgacacgccgatcgcgcgtaccttgccggccttcacgaattccgcgagcacgccgagggtttcctcgatcggcaccgtgtaggcgtcgtcgacccacggataggcgggacggccgaacgtcgtcgtgctgcggtcgggccagtgcagctgataaagatcgacgtagtcggtctgcaagcgcttgaggctgccgtcgagcgcttcggtcaggttcttccggtcgaactggttgccttcgccgcgaatatggcgcggattgtgcggctgccgcgccggccccgcgattttcgtcgcaagcacgatgcgctcgcgctgcgcgcgatgctgcgcgagccacgtgccgatgtactgttcggtgcgcccctgcgtatcgggcttcggcggcaccggatacatctccgcggcatcgatcagcgtcacgccttgcccgatcgcgtagtcgatctgctcgtgcgcatcgcgctccgaattctgctcgccccacgtcatcgtgccgaggccgatcaggctgacctcgatgcccgaatcgccaagtgtgcggtattccatgctgttcctgtcgcgtcagtggaaagcaggaacgctatcacattgaagcgaccgcttcagacaggcgccgcacacgcttacaggcggccttcggtaaaggtgcgagcgttcacgcgcagggcccgaacgaaggcgttgcagccgccgttactgcggccgctggatgaaacaggtcaccgacgcatgcgcgacgatcttgtcgtccggcgtcttcagcgtgccctcggcaacgccgagcgaacgcgacaggtgaatcacgcgcccttccgcaaccagctcgacgtcgcgcggcacgggccgcagcatcttcacatgcagatcgaccgtaccgtagccgacgcccgcatcaagcatcgaatgcaccgcacaccccgtgaccgaatcgagcaccgtcgcagcgaacccgccgtgcacgccgccgagcgggttcaggtgccggccgtccgcccgcgccgaaaatttcacataaccgagctcgacgtcgagcggacgcatcgggatcgtctcggtaatcgacgcgagcggcgcatcgcccgataccgctgcgcgcagcagatcgagaccagacagggaaagcgggttcatcgggttgtctccgggttgaaagcgcgtcgccgcgcgagtaagttccaaattggaactgattattcacaacgatcacggtcgttgtcaacgtggccgggctcgttgcagtcgaaggcgggttctataatcgagcccgctatttcgctgaaccgccgcaagagactcgacgatgaaatgggatgacatcggcacgctgaactgttcggtcgcgcgtacgcttgccgtgctcggcgaccgctggaccatgctgatcctccgcaacgcgttcctcggctgccgccgcttcgacgcgttccagacccagctcggcgtcacgcgccatgtgctggcggagcggctcgcgcggctcgtcgacgaaggcgtgctggccaagcgcgcttatcaggaacgcccgccgcgtttcgaatatcgtttgacggacaagggcctcgacctctacccgaccctgcttgcgctgaccgcatggggagaccgctggaaagacgacggccaggggccgccagtgcagttgcgtcaccgtacctgcggccatctgatgcacgcggtcaccgtatgctcggcgtgcggcgagccgctcgacgcgcgcgacgtgcagccggagcgtggccccggatgggtcgcagccgaagctgccggaagggctgcggccgaggactgacgcatcgcgcgtacgggagcgcgtgacgcacacggatcgttcgttgcgttcgcgttgctgtcgccggttccagcgagcctacctggttgcactctcgcacggcttgcacgccgacaccctgccgccgcacgcgcattcacgcgctgccatcgcccccatccgcctatcgccccgatcgcacacacggattccgcacaacgcaactttgcgtcaccgcctctgccatcgccggtcttcgcgatgcgtcatcccgttgcatccgcacgtgaccgggccgccacgtgtgcgttacactcacggcccgctgtctcgaaattattcgctgtccaagatgttgtcgcgcaatcgcctcgccgctgcctgtctcgccgcctccctgctcgccacaccgttcaccgctttcggcaagacgcaaagcgaatcgctgctccagcaggcgatcgacttcgtgtcgcggtggctaccagcccccactcacgaagcgcccgcaacacaggtcgtcgaatcggcattttcgcccgatggcggtgccgaagcgctggtgctgaaagcgatcggcgccgcgcgcagttcgatccgcgtcgccgcctattcgttcacgtcgccgcccgtcacgcgcgcactgctcgccgccaagcgacgtggtgtgaatgtcgcggtggtggtcgacgacaagggcaatcgcgcaaagagcagcaagcaggcgttgaacctgctcgtcaacgcaggcatcccgacacgcacgatcgacgcctatgcgatccatcacgacaagtacctcgtgatcgacgccgagcacgtcgaaacgggctcgttcaactacagcgcgtcggcggccagccgcaattccgagaacgtcgtcgtggtatggaacaacccgcaactcgcgtcacgctatctcacgcactggcaaagccgtttcgaccagggcacgccataccgctcaagctactgacgcgcgccgcgctcaccccgtgttcgatccgccgtgttgcagatgatcggcgagcatcgcgcgaagctcaattcggccgaatggccaacgcgtcgcctgcttaatggatttcagccgtccgcccggccgcggcaccggcctgcgccatcggcgcgcagcgattcgcatgcgcacccgcgccgcgtaccgacgacgtcgacaagccgctggcgccgcccggcagcgcgttgctcacacatacgacgccgaacgccagcgtgttctggaccatcggataaagcagatacagcgcaaacgcgagatagcccgcgtacagaattcgaaccatggtggagtgggaggcgatgaacgattgactcgccctgtttacggcactgcgccgggcaccttgagacgtcgcgcaccggattgcgcatcggggcgaaacgcgggcccatgacgcccgcttctcaccgcatctgcaacgatccgggccaggccgaaaccgcccgcttccggattgccggaatggcgatgcgccgcgcaatgcgcgatactgtccggcatacgatcccgtgaccggcctcgcagccgggacaaaggacacgacccatgcaaattgcaccgaaaccggccgacgaggcggcccggctcgatacgcttcattcgctctcgatcctcgacacgccgcccgaagaacggttcgatcgcctgacgcgtcttgcacgcaggctgttcgacgtgccgatcgcactcgtcagcctcgtcgacgacgatcgccagtggttcaagagccatgccgggctcgacgtcacgcaaacgtcgcgcgacgtgtcgttctgctcccatgcgctgctcgcgggcaatacgatggtgatccaggatgcgctgaacgacgatcgcttccacgacaatccactcgtcaccggcgcgcccggcatccgcttctacgccggccggccgctcgcggcaccgaacggcgcgcccatcggtacgctgtgcctgatcgacacgcggccgcgctcgctcgaacccgacgagctcgcgctgctcggcgatctcgcccacatgaccgaacgcgaaatcgccgcgctgcatttcgcgaccaccgacgagctcacccagctgacgaaccgccgcggcttcgagatcctggcccgccacgtgctgagcctgtgcgatcgcctgggtcgtcacgcggtgctgctgttcttcgacctgaacgatttcaaggcgatcaacgaccgcttcggccatgccgagggcgaccgcgcgctcaaggcatttgccgacacgctgacgggcgcactgcgcgacagcgacgtgatcgcacggcttggcggcgacgagttcgtcgcgctgctgagtgccaccgatccggccgacgtcgccgagccggtcgaccgcgtgacgcaggcgcttgcgctgcgcaacacggccgacgcgcgcggctatgacatccggttcagcgtcgggcacgtcgactacgaccccgcgcaccatcacgacgtggccggcctgctcgcatcggccgaccagcggatgtacgagcacaagcagcgcggcaggtcggccggcgcgtgagcgcgggcacatgccgccgccctgccgttcaattgcggcggcgcggctgtgtcagctgccgcacggcggcgcgctggccatcgcctccgcgatctgttcgggcgtcaggtcgcgctggtgcgtcgcgagcgaccagcgatgtccgaacggatcctcgacctgtccgtagcggtcgccccagaacatgtctgcggcaggaatcgtcaccgtcgcgccggccgcgaccgccttcgcgatcgcggcgtccgtgtcaggcacgtacaggtgcaggcagaccggcgtgcctctcagggccttcggcccgagcgcgccgtgttcgggcatttcatccaccagcatcagtgtcgaatcgccaatcacgaggcacgcgtgcgcgagccggccgtcaggcatcgccaggcgaaactgttcgctcgcattgaacgcgcgcttgtagaagtcgatggctgcggttgcgccggcgcagatcaggtgcggcgtcagcgtacgcatcccttccgggatcggtttgacggacgtggacatgggtgtcgctccttcggtcggttgtcgtatcggaatcgggacggacgcgcgatgcgcacgcctccgatgctacgacggacgaccccggcggaaatcgacacggcgccctgcatttttctcgagtatcagggcgcccgaggtcgccgcatcgggcgtcacccgcccgttcggtcgacctcgttgtccggcatgccgaactgccgccgacatgcctcgagcagtcctgccaccgcatcgagcggaagatcggcaaaccgggcaatcggcagcatcacgccgcccggcaccctggtgcgcgacgaatgcgccgagaactggtaggcgatgtagcgattgcctgcgacgctgatgatccggaattcggtgacatcacgccatggcgtggcgggttgttcgcgtacgcctccgatcagcctgaaacccgtctcgtcgacatgcagcaccatcctgcgtcgcgacgacacgaagaaggcggcccccgccagcgccagcaatccggccagcgccgctaccggccagagtgccggagcggccgcataaccgcacaggcttgccgcggccagcaccatgcacgcgatcgcccttcttttcaggctccggctgtcaaccgccagcgtcaccggcaactggccgatgatcgttcccgcgaccggatcgacgtgccagccggaatcgatggattcaagtgcgtctttcattgtgcgatcgctcacctcgacagccgccgggtgatcgaagttggacaccccgtcgatgcgctgaaacggtcggcgtgccgacgggaaatgatcgtgatcgaaaaaggtacgcatcgacgcacggcagcacgcactcgtccacgcggaacgggcagtgcccggccggcaccggtcatattcagttgcacaccttgacggtgccgttggtcgtgcattgaccggtggcccagtgactctgccctgccagatgaggcgccaggccgatgccacggatcggcgcggctggcgacgatgccggaacggctgcggccgccgacgcggcgtcgggcgacggcagcggaggcggctcggacgccgtctggcaagccgacagcgccagacaaagcgcggatgcccacggagcgatgagggatctggacatgatctcgtacgcgtttgcgaagttcgcttccggtaacggctcgctgaagatcgcgtggcccgtcaatccgttcggcacaaccggccatgcggcacgacgatcgtccaatactactcctcgcgatcgacgtcgtgcgagctaccgttcggccaggtgccgccattcatgcgacggcgcatgccgcttcggtcagatttgcggcagatcgcgcaacgtgcgcgattcgttcgttgcatcgatgtcgagctcgatgccttccgatgcatcgcgatacagcacgcgtttgagccggggcccgatcgcggtgacgtccgatgccgaaaagattgcgcggacatcgttgccggacgcgagcgcgcgcgccacgtccgccaccggcgcttcgctcggcgtcgtcgcccacgaccggtcggacggattcacggccgcccagcgcacgtgcgtcacgcgcgcgctgagcggatcgattcgcacaccattcaccgcaaacatcgacatcgacatcggcatctccttcgaatatttttgcggcccgccgtaccgatgcacggtcacggacggccccagatctcgcagacgtttcccgccgggtccgccacggaaatcgcaaccgtgccgtcgccgtagtcccactcgttcaggatgccgacgcagcacgactcgagccgtgcgacggcttccgacacatgcgcgacttcaacggccagcgcaatgccatggccggtcggtcgaaactccggatacggaaacctgccgccgctgccggtgtgaacggtcagcgttgctccgcccatcacgaagcggtgccacggattccccgcggccgacacgccttcggagtgaaccggcagcgcaagcgccagacggtagaaatccaccaccgcccgaaagcgatcgtcttcgaccggcaccaggatgcccagactcgcgatcatgtgcgcccctccggtcaacgcgattttcgatgatacattgggacgctttacaaccgtcaacagacaatcgtgcacgggagaaacacatgaccgacgcctggggaaccttccctgccagaatgggcgaccatcaggctttcatcagcttcaaccacgactttgcggaaatcgcggaaggcgatccgcgcacgtcgctgctcagcgtgcgcgtcccctttgcgcatccgacgccggaaggcctgccgaccggcgacgaattcgccgatctcgcgaagatcgaggacctgctggacgccacgatcacggcgaaaggtggtgtgcaggtcggccgcatcaccgtcgacggccatcgggatttccttttctacgtatcgctcgacgaagaggccgcggcggagatcatcgacgcgctggccgatcagacgacctacgcgttgcagtacgcgcaccaggacgatccggacaaggaagcgtactggcagacgctctacccgaccgacgacgaccggcagatcatgcgcgacatgcgcgtgctggacgaattgcggaagaaaggcgacgccggcgatgtaagccggcgcgtgatgcactgggcgtacttccccgaccagagcgacgcgcatcagttcgcggactgggccgaagcgaaaggctatccggtcgaatcggtcgcccccaccgaggacggcaagtcggccgtacggttctcgcacgagggcaccatggcactggccgacatcacgcgccatacggtcgcgatcaatcgcgaggtacattcgttcggaggaatacgacggatgggaaaccagcgtcgaacaggctggccgagcgggttgacctgcccgccgcaagcgacgtgatgcaacgcatccggcgcaaacatcccggcggcattgatgcgcgccgccgggaccaaggcatcaccggccgaaaccggcgatgggcctgagggttcgctcaggcacgaggaaagcgatacgtgcggaccgggcgatcggatgcagggacacgcaaccggtgcgattgcgctgcccgccgaacgcctgtccggttccgccgacgcggccttgcggcgtcggacgggcaaaaagccccgctcctgcgcgagcgagcggggaaatggttgaccgggccggggaagaacggtcaaccggccagattgtgagcgccggccgcgcaacgatctgtgcggcaactcaccatttggtgacaatgccgcggcaaccggcacgctcgcgtgccgcgcggatcgcgtcacggcccgagcgcgacgcccgcgaccggcgcgagcaacaccacgatgacaggcgacagcaccaccgccccgatcatcatcacgccgtcggccgcgagcgtgacgggggtcgcgagcacgcgcacggccttgcccgccgtggtgatgcgatcggtgacgtcgatcttgtacgaatgcgcaaacgacgaccacgtcttgccctgtgcaaaaccatcggccagataacgcgaaccggccagtccacccttcatctccagatccctgctcccgcgcatcgtgaagccgtcctccagcgcgcggtccagccctcgtcggtcatatcggcgcgacggagccggagccggaacttgcccgagatcttgctgccctgcgcgacgaattcatagagcgacgcgttgatcgacttgcggtagggcgatgccagcacggcaccgaggtgctcgggcatatcgaagatgtagtgatatttctcgccgagcacgacgaatttcttgccgtcctcgctgacgagaaatcggtcgaccgtctcttcatatcggccatcttcgaacagcattgccgtgcagcctgtcaggccggcggcgacaacgatcgcgcccgccgtcagcagcgctcttcttttcatgtctggaatttgatcttgttttaatgcaagcggatatcttcaggcccggcgcaagtctccgttaagtcgcggctgctgtcaaagcaggtttattctatttttccgatcgacacgattcaggcttcatttttctgcatctttttgaaaccatgtttcgcgaacacaagagcccgcatcatgacagccgggtttcgtcctcataccggtcagctgaaaagccattcggcaaccatctcgatccagtcgagatcgctggcgatgtcgatgacggtttcaccgacgatttcggcagtcgatgtggtcgatgtggtcgatgtcgttgacgcgttcgatgcagccgatgcgcccgttaccaacgcgccggcagcgaccacattcgccttcgccatttcggcggaagcacccaatcccggagcggccagccgctccagccagtcgacgatattggcacgcgcatcctcttcatccgcgaaatcattccgctcgagatagcggtcgaatacggtccacgcaagtgtcttgcttcgcgaagcggattcgagatgccaatcgacaacgcccgtccgaccggactcctgacttcgagcgtcgcggtgaaacagtaatcgagatattcgatctcaagtttcgacgacatggttttctccggtcaatccgccctctctgttcttgtgatcatccgggcttgccgggtttcgcgacacagtgtgaattctgcatgaaattcgcgcgacggatcattcccgctggcgggatcacgatattctcataacctgtcgataacgatcgccgacacatgactgtactcgatttgcttaccattccctcggcgctttcgctcttggttcagttctgctgcaagtcaccacgctttcctgtaccgggtattgccctgcttcgccatcgcaatcgcaatcgcactgctaaactccggccaagacggccgcttgcaataccagaggaaaaatggcactcgcccgcgcacaacaaaatggcgtagaggtctggattgtccagcttcccgggcacactccgtatgcccatacgcacctcaagcgggtattctcgtgcgacgatacgcgacacagggtcgtgacgatcgacctgccgaaactgctggcatgtgccgaccgggacacgacggactacgtgttgccgcctgttctttactgggccccaggaaaagccgcgggcattcgcgaattcctcgatcctgaacaggacaggattccggacatgccgtacatcacgtttcgcgagacgagaacgcgaacgctgctcggcatccccgggctgtcgaaggtcggcgtcgcgtcgttccggaacggccagcatcgcgctcgctatcttgcctatgcaggtgcaacgaccctgcccgtcgaagtgcacgagacggaagccgatttgctcgtgcagtactgcggcgtgtcaccgtgaagtacgttcggctttcgcccggcgatggccgcgcatcatgcggccgttcgctcgaatgtggccaggtggctaggcctgtatcgcatagatccggtcggtgacttccgtctggccgatgcggctcgtttcgatacccgccagttgccatccgttgtgctcgtagaaaccgatcgcgcgctcgttgcccgccaacaccttcagatggacctggtgcacgccgagcgttcgcgcccatgcacggacggcttcgatcatgtgcttgcccgtgccgcctccgtgatgcgaaggatggacgtgcaggcagtcgagcagcacgcccagcgccggatcgacggggcgctcggcactgacgaaccccacgggctcgccgtccgcctcggcgatcagcaccaggccccgctcgttttcgttgcgatcgaaatattgccgccaccgagtcgcatgttccgtcggcacctcgtcggacaggtaggtcgccggcaagatatggctgtatgcagtttgccagctcagcgtgtgcaggcgggcgatgtgccgtgcgtcttgcgctgtcgcggcacgcagcgtggcacgggtttccggcatcggtggttactccttccacttgttctcttgatcgggacgtctcgccgcgaaatataccgcgtggaggcgcgcaaggctcaatgtcgccacgcgcaggttatcgtcgcgtatcttgcaagtgccgtcgccgcacgttggctcgtgatgtttgcaggcgctcgcctccgtcacgcctgacgcgatcgcgtcagcagttgtctgccggacgccatgcagggttcgtgcaccactgcagttcgttgccaaaacaacgaggcacaggcaaaaaaatcccgacactgtcattggctgtcgggatcgaacggccctgcaaagcatgagggcacgaggaagtcgatacgttacaccaatgtaagactgttgcgcgctgtcggctcgcgccaagtccctgtctcattccgccataaacgaaaaagcctgctcacgcgaaacgcgagcaggcaagaaagcggatcagcattcgaggcacgagggctgtccagaaaagataacggcaccgggagcgagaaccttagtcgaaaaaggaaattgcgcaacatcacgtcgactgaatacggccatacaatctcgcgtcgacgatggattgccgaataccggcggcactgtggcgatatcctgtccaatcggccatgtatggcaaacttcggctccgaatcgacgcagcgcgcactctttaccgcaggggaatcatgtacgtcttgatctatatcgcagcggtcgccgtcgccaacctgatggtcgctcatttcgggccggctgctacaccgatcatcgcgttcctgctgatcggcctcgatctcgcgattcgagaccggctccacctcgattggcgaggccgcgcgctttggtcgcgaatgtttgcgttgatcgcggccgccggtgtcgtcagttatgcactcaatcccgccgccaaggaaatcgccgtcgcgtccctggtggcgttcggttcggcagccgtggcgagcgcagtcgtgtttcaactcgcacgtcgctttccgatactggcgcgcgcaaacggcgcgaacgtcgcgggtgccgctgtcgactccatcatctttccgcttattgcgttcggggccgtgtttccgacgatcgccgcgttgcagttcgtcgccaaggtggctggcggcgccttgtggtcgtgggtggtgtttcgaaacactcgatcggctcaggcgggaatcgcgagcaatgtggtcgatcgttgaggacgggtttgcttttcgcggcattcgctacgttcgaatgcgcgtctggcaggacgcccaaaagcaacaatctcgacctgtcgcgccgtactccatcgccatgcgcttgccgtccgaatagcggcgacgacgttttgatagatgaaggccgaagcgcatccagcatcttgcgccagcttcagcgcctgactcacctgctcaagaaagggaaacagcgcgatgacgttgcgaggatgacgcggatcggaacctatcgggcgggaaccctggccaagcgtcttacaagcagtgctgcaagcacctccagctgatacacgatcgccacgacgttgcacgcgatgagggcaaagtcaccaaaatccaccgggtgcatgggataaccgattcggtggttatcgatgatttttcgaacgaggcaatggccgacggcaagctgacgacgctcccgcagatcaacagaacgctgactcccgcaacgtgtttgattcgcgcctttgcggcaaaacacaagttgcgagaagcaagccgatgccgcctgcggtggaaaaagaaaagaccacgctataggccaatccacggtccaatccagcaaaaatggataaacacaagccacgacaagatcagcaggggcatcgccggcgtgactccagcgagcagataaaaggacgccctcaccaccctgagagtcgtcatgaccgtaatctttggccttgaaccggtttgccgttccgttgtctgggcaacgggtttactctttgaccgcatggattcccgagaagcctcgaattccaaatcctgtggagcccatcaatttaccgtagaacgccgctccgccaatagagcgcgtgaacgcaaccggaaatttgaccgcccgctcctttcggcgcattggcgcggctgcgttcattcattcggattcccggcaccgcaattttcgactgcacgaagtacggcactcggcatgtctacgcgatcgcgataccgttggccggaatgacccgctcgtgtgagcgatgcagctcaagcacgacttcgagttgttcccgactggatgcgcaaaatggatggatggcgagcagaacgctctggagggggacgacgaggctcgaatcgacgctattgcgcctgattgcctcccgcaaagcaaaacaggcgcctaggcgcctgttttgttaatgcattcggtggggtggctgatgggactcgaacccacgacgacaggaatcacaatcctggactctaccaactgagctacagccaccactgttactgctttttgttcttcgctgcttttgtgtttcagcagcgaagaacaagattatacgaacacttttgaatcttgcaaagctttttttcaaaaacttcttcggcctcgttcagatgcgcgcgcgcctcgtcgaacacggccagatcgccgcgtgcgagcttcttgttgtccgacagcacacgacgccagccacgtgcaccgggcatgccgcgatacagtccgagcgcatgccgcacgatcgcgccgaggtaggtaccgcgcttcagttcggccgcgcagtattcgatcagcttcgcctcggcctcttcgcgcgtcggcgtcgctgccgttgacccatagaagcgtgcatcgacctccgcaagcacgtacgggttgtgatacgcctcgcggccgagcatcacgccgtcgacatgctcgagatgctgcgcaacctcgtcgagcgtcgtgatgccgccgttgatgacgatctcgagcgaaggaaaatcgcgcttcaaccgatacgcatagtcgtacttgagcggcgggatctcacggttctctttcggcgacaaccctttcaggattgcattgcgtgcatgcacgacgaacgtttcgcagccagcctcggccaccgtgccgacgaagtcgcgcacgaatgcgtagtcctcgaccgcgtcgacaccgatccggtgcttgaccgtgaccggcaccgacaccgcatcgcgcatcgccttcacgcagtccgcgacgagctgcggctcgttcatcaggcaagcgccgaacgcgccgcgctgcacgcgctcggacggacatccgcaattcaggttgatttcgtcgtagccccactgctcgccgagcttcgccgcgcgcgcaagatcgtcgcgctcgctgccgcccaactgcagcgcgaccggcgattcgttcggcgtgaacgcaagatgccgctgggcatcgccgaacaacagcgcgcccgtcgtgatcatttccgtaggcagccacgtatcgcgcgtcagcgtccggtggaacgaacggcaatgacgatcggtccagtcgagcatgggcgcgacggatacgcggcggggaggaagcgaggacggtacggacatggatttcgggcaacaggccagacggcgcggaaacaacccggcattttaccgcaacagcgtgcaggcctgcccggcatgcacgctaccctcgcccagctccgcatcgaccgcccgccgcgcctcgtccagcacgcgctcgatcacgcgtcgctcggtcagcaggatcccgtccaccttgacgagccgccagtcgatccgcacggcatcgccctgcagcacgcggtaatgcgcatgctcgccgtcccagacctgctcggtcttcacctcgatctcgaagccgcggtacggctcgctgaaatcgccgaggtcgctgcctctcggttccatcgcacgctccgtggcgacgcagcaccaggccgcccgcgcggccggcgccgtgcgctcaatcgtattcgtcggacaaaaggatttgccatcggccgtcaggtcgacccggtcggccgccgcctgatagatcagccctcgttcagcaacgcgtagacgacgtcgtcgaacgcagcgggaaccggccggctttcaccgaactggtcgatccacttcagcgcctcgatggcttcggggaaaggatggggtcatgcgtggcctccggcatcggtgtcgctccatcctagcacttcgtccggacgtcgaataccaaggcaaacgcgctgcgcaaatgccgggcggcgccaacgggcagattgcccgcggcgccgcaccggcgcgggacacgcgctcagaggcgtgcgatcgatacttcggtcgatttcacgagcgcgacgacttccgcgccgaccttcagttcgagttcgtcgaccgaacgggtcgtgatcaccgacgtgacgatgccgaacggcgtctcgacgtcgacctcggagaccacggatccgcgaatgatctccttcaccttgcccttgaactggttacgtacgttgattgcagtgatgctcatcaggttgatcgctccgaagaaaaagatctcagaacgggcggccgctgccgcccggatttaaacggcccagcggatctgcccgaccggtcgaacgttgtctgcctcgtgcacctcgccctgtgcgtccgcaccgggcccgccggcgagcacgcgtttcagcacgcggtcctccagcgccgcaaacgcggccgatgcgcgggcgcgcggccggtcgagcggcaccggttgatccagcgccacgcgcccctgctcgatgagcaggatgcggtcgccgagcgcgacggcctcctgcacgtcgtgcgtgacgagcagcgcggtgaaccgatgctcacgccacaaccgctcgatcagtgcatgcatctcgatgcgggtcagcgcgtcgagcgcgccgagcggctcatcgagcaacagcagttgcggccggtgaacaagcgcgcgggccagtgccacacgctgccgctggccgcccgacagttgcgcgggccagtcgttcgcacgctccagcaggccgacttcgtcgagcaccgcgcgcgctttgtcgcgcgcgccgcgtccgaggcccagcatcacgttctgcagcacggtcttccacggcagcaggcgcgcatcctggtacatgatccgcgtgtcgagcacgccgccgccttcgccacgcgtcacgagcgcgccgctgctcggctgctcgagcccggcgacgagacgcagcagggtcgatttgccgcagccgctgcggccgacaatcgcgacgaagctgccgcgtgcgatgccgagctcgacgtcgtcgagcaccgtgcgtgcgccgaagcgcttgctgacacccgacagcgtcaccgcgtcgtcgggtgccgggcttcctgcccgccgccgcgcgagcggaacgatggacgcactgccgtcacggtcgaggatcgccgcatcccgcgcgtcgccgtccgtgacacgcgcctgcgccagttcgacctcgaggtctgcgccggcaagcgggccgtaggcggccgccgaagtcgtcgcattcatgcctttgctcctgattgataagccgggtgccagcgcagcgtcacacgctcgagccatttcgccagcacgtcggccagcttgccgagcaccgcgtacagcaggatgccgaccaccaccacgtcggtttgcaggaattcacgcgcattcatcgtcatgtagccgatgcccgactgcgccgagatcgtttccgcgacgatcagcatcacccacatcagcccgagcgcaaagcgcacgccgacgagaatcgacggcagcgcaccgggcaggatcacgtcgcggtacagcgcaaagccgcgcacgccgtagctcttcgccatctcgatcaggttggcgtcgaccgagcggatcccgtggtacgtgttgatgtagaccggaaagaacaccccgagcgcgacgaggaacagcttcgccttctcgtcgatgccgaaccacaggatcacgagcggaatcatcgcgagcgccgggatgttgcggatcatctggatcgtcgaatcgagcgcgacctcggccgccttcgacaagccggtcgcgagccccagcgcgaggccgactccgccgccgatcgcgaaaccgaacagtgcgcgccatgtgctgactttcacgttcgcccacatttccccgacgtcacgagcgaccaggccgctcgcacgaccgccacgggttcgggcagcacgcgggtcgacagccagccgatgcgggcgccgacttcccatgccaccagcagcgcgagcggcacgagccacggcgcgacgccgcgccatgcgcgggcggccagggccgccccgtcgccgacgttttcgttgtcatcgcaggcctcctgtcactcagctctgggctgccttcggcagatagctgttgccgacgatctcgccgaacgggccggacagcgggccggtcgccttcgccgcgccgttgcccttgatcagcgggaacacgagttccgcgaaacggtacgactcctccaggtgcggataaccggacaggatgaaggtttcgatgccgagatccgcgtattcgcgcatgcgctccgcgacctgctccggattgccgacgagcgcggtacccgcgccgccgcgcacgaggccgacgccggcccacaggttcggatacacctcgagtgtctcgcggccgccgcgcttgccgccgtgcagcgcggccatccggcgctggccttccgaatccatgttcgcgaacgccttctgcgcgcgggcgatggtttcgtcgtcgaggcggctgatcaggcgctccgcgtcgcgccatgcttcgtcctcggtctcgcgcacgatcacgtgcagacgaatcccgaacttgatcttgcggccgcgggcttccgcgcgggcccgaatatcggcgatcttcttcgcgacggcctcgggcggctcgccccaggtcaggtaggtgtcgatgtgatcggccgcgatctgatgcgcggccggcgacgaaccgccgaaccacaacggcggatgcggacgctgcacgggcggatacagcgccttgccgcccttcgactgcaggtgcttgccgatgtagtcgaacccgccgttgtcgtgcgacgcggacagcagcccgcgccagatgttcaggaagtcgtcggtgatttcgtagcgcgtgtcgtgatcggcgaacaggccgtcaccctcgagttcggcggcatcgccgcccgtcacgacgttgatcagcaggcggccgcccgacagacggtcgaacgtcgcggccatccgtgccgacagcccgggcgacgcgataccgggacggatcgcgaccaggaacttcaggcgctgcgtcgccgggatcaggctcgacgcaacgacccacgcatcctcgcaggaacggccggtcggcagcagcacgccctcgtagccgagcgtgtcggccgcaaccgccacctgcttgaagtaatcgtaatccgcggcgcgtgcaccttcggccgtaccgagatagcggctgtcgccgtgcgtggggataaaccagaacacattcatctgctgctcctgcttgactgtccttgcctgaatttgaaaaacaccgccctgctcgcgtcgcggatcagcggcgcatgcatggtgtgcgttcgaatcgggatggttcgccggtcaggccgtgcagcgggcgaggacgcgattgcacggctgtttctgggaaatcagtctagggatcggtacagggctttggaacgattttttgagcttaggttttccgctttcgtgattagcacgacgctggagcgaatatcaccgcgggcgggccctataatggcgcacctatccgaataactccgcgcgtacagccccggccgtgcgcgcctgcggtgcactcatcgatgcagaaagtcatcctgccattcctgtccggcttcctggccgccctgttcttccgcgaagccacgctcgcactccttcatacggccgatctgatcgccgcaaccggcttctccacgcagccgttcgcgccgctcggcattcctgaatttgtcgcgaatgcgctgatcagcgcgtgctgtgcgatcccgatggcgtggctgctgcgcgtctcgccggaacgcgaggcatcgtggatcggcgcgctggtgttcggcggcatcgtgctgacggccgcccgcgtgttcgcgatcgatccgctgcgcgggatctggccgtcgggcaacatgatgcccgtgctcgccgccggcttcgcagcaaacgcggtatggggcttcggcgcgctcgtgttcatgcgtgcgttcatgtcggacgacgccggcgacgagtaacgcgggcgcaagcgctacgcccttcggccgccgggcggtcgacatccatgcaaaggccgcctgcacctgcaggcggcctttcgtttccggctcgcgcgtcggtcggcccgacgtcagtcctgcagattccgcagcggatgcgtgtcaggtgtccacgggctgtcgaacatcgcgagcacgtctgcacgatcgatatcggcggacgacttgaagcgccagaccggctggtggtccttgtcgacgatcagtgcgcgcacgccttcgatcacgtcgccgtgcgcgaacgtcgagcgtgtgaggtcgagatcgcgccgcaggcaatcggccatcgtcgcgccgcgtgcacgttcgacgacttccagcgacacggccatcgacagcggagacaactgttcgcgcatcgcatgggtcgccttctcgacccatccgtcgacggccgcgcaatcctgctcggcgtcgagcgacgcgagaatcgcgacgatgtcgggctgcgcgaaatgccggtcgatccccgcgcgcgcgtcggccagcgccgacgtgtcgggcgtcggcacgaccttgtgtgcggcggccgcctcggctacgcacgcgacggcctgctcgccgctgtcgatgcgcgcgtgacgcagcgtgtcgagcagcgccggcagcgcggcatcgggcagatagacgtcggcgagctgcgcgtacagcgcgccggccgcgtcgagcgtcgcgccggtcacggcgagatagcggccgatcgcgccgggtgtgcgcgcgaggaaccagctcatcccgacgtccgggaacaggccgatacgcgtttccggcatcgccatcttcgtcgagtcggtcacgacacgcaggccgcccgtgtggcgcgccgcctgcgaaatgcccatgccgccgcccatcacgacgccgtgcatcagcgcgatgtaaggcttcggataggtgaagatcgcgtggttcagcgtgtattcgtcgatgaagaacgtatcgaccgcatcgcggtccccgcgctgccatgcgtcgtggaagaagcgcacgtcgccgcccgcgcagaacgcgcgcggatgcgggctgtgcacgacgatcgcgacgacctcgggatcgtcgcgccacgcgtcgagcgcctgctgcatcagccggatcatgccgatcgacagcgcgttcagcgccttcgggcggttcagttcgagaaagccgatgcggttcgcgacatacgcgcgtacgtcgggctgggcggattctgcggaaacggcagcggaagtgggagtggaatcggtcatgagggccatccggcaaatggcagtcgcacgctcagtgcgcctgcatcttcgaaaacaggttcagcaccacgacgcccgcgatgatcaggccgaggccgatcacggccggcaggtccggcacctggcgatagagcagcatcgcgacgagcgtgatcagcacgatgccggcacccgaccagacggcatagatgatgccgacgggcatcgtgcgcaacgtgagcgacaggcagtagaacgcgatgccgtagccggcgacgacgagcgccgacggccagaagcgcgtgaagccgtccgccgcgcgcagcgcggacgtgccgaccacttccgcgacgatcgcgatcgcgagccatgcgtaaccgggaagctgcatcgctcagttccttgcgagggccagcacagcgtagtcgtggccgagctcggcacacagcacctcgacgacgaattcgtgatccgcgcgctgcggcagcccggacgcggtgatcgagccgatcacgccggcgccggcgacggtcagcgggaacgatccaccgtgcgccgaatattcggcgatcggcagcccgtgcttgtccgccagcgtcgcgcccgcctgctgcatgcgcaggccgatggcgtacgaactgcggcggaaatgcgcgacgacgttgcgcttgcggcgcacccagtcggcgttgtcgggcgtggctccggcgagcgccgcgtagaacagcggctggccgaacgtgacgatgtcgagcgcgaccgcatggccgcgagacgccgcgagcgcatgcatccggttgccgagcgcccacgcgcgggccgggtcgaaatgaggaaacacgagcgcctgttcctgcgcgccgatcgattgcagatcgtgagcgatgtccatgaatccgtcgatgcagtaatgagagttgcaacggcgccgatgcgatcgcgcatggcgtcgctggcgaagaggcgaaacaaaccgttcgattctagcgcacgcgcccgacgtaccgtccctacaagacacgacacgcgattgtcagaaagtgcttgcacacgttcgggtaactccttataattcatttcttcgacggacgcggggtggagcagtctggcagctcgtcgggctcataacccgaaggtcgtaggttcaaatcctaccccgcaaccaacgtcccgattcatgcaaaagcccggctcagtgccgggctttttgtttttccgtcgcatttccctccctcttcgcgcatcggcaccttccgcttcgcgcgacacgcggccggcatgcgcaggcgttcaagaatgccgcgacccggtgatacactcgcatcacctcgtcccttccactcgacatgaaattctgctccgtctgcggtcacgaagtcatcgcgcgcattcctccgggcgacaaccgcgagcgcttcgtctgcgatcactgcggcacgatccactaccagaatccgcgcaacgtcgtcggaacggtcccggtctggggcgatcagatcctgctgtgccgccgcgcgatcgaaccgcgctacgggttctggacgctacccgcgggcttcatggaaatgggcgagacaacggccgaagccgccgcgcgcgaaacgctcgaggaagccggtgcgcgcgtcgaggtgcagaacctgttcacgctgctcaacgtgccgcacgtgcaccaagtccacctgttctacctcgcgcggctcaccgatccgggattcgaagccggcgaggaaagcctcgaagtgaagctgttcgacgaagccgacatcccgtgggacgaaatcgcgttcccgaccgtcagccagaccctgcgattcttcttcgccgatcgcgccgccggcgactacggggtgcacaccggcgatatcttccgctcgctgcgcaacggctgagccctcgccccatggtcccctggctcggcccggacgatccgtttccgcccatcgaacgcgcgctcggccccgcaaccggcgcgccggggctgctcgccgcgagcgccgacctgctgccgtcgcgcctcatcgacgcatacctgcgcggcatcttcccgtggtattcggacggccagcccgtgctgtggtggagccccgacccgcgcatgatcctcgtgccggccgagttcaaggtgtcgccttcgctgcgcaagacgctgaagcgcgtgctgcgcgagcccgaatgggaagtgcgcgtcgaccacgactttccgggcgtgatgcgcgcctgcgcgcaggcgccgcgccgcggccagcgcggcacatggatcacggccgagatcatcgatgcatacacgtcgctctaccggtccggcaacgcgcacagcatcgagacctggcacgacgggcgacgcgtcggcggcctgtacggcgtgtcgttcgggcggatgtttttcggcgagtcgatgtatgcggacgcgaccgacgcatcgaaaatcgcgctggccacgctcgtcgcgcaccttcgcgagcaggggctggaaatgatagactgccagcagaatacgtcgcatctagcgtcgctcggcggccgcgagatcgcacgcaaggcctttgtcgctcacgtgcgcagcgcggtagccgaaccgccgattccgtggcagttcgacaagcgcgtgctcgccgcgctgacgggccgcgccgaaacggtgccccctccgggatcgagcgctagcgcggcactccctccctgcaacgagagctgcccatgactcatccgactgagctgccgctttcaccgctttcggcgctgcaattctatgcaacggcgccctatccgtgcagctatctggacggccgcgtcgcgcgctcgcaagtcgcgacgccgagccacctgatcaattccgacatctataccgagctcgtgaaggccggcttccggcgttcgggcgtcttcacataccgcccgtactgcgacggctgccgtgcctgcgtgccggtgcgcgtgcccgtcgacgcgttcgcgccgtcgcgtacgcagcgccggatgtggaagcggcaccgtacgctcgtcgcgacggtttcgccgctgcactacgacgaagagcactacgcgctctacatgcgctaccagtccgcgcgccacgcgggcggcggcatggatcgagacagccgcgaccagtacgagcaattcctgctgcagagccggatcaattcgcgcctcgtcgaattccgcgacctcgacacaccgggcggcgagcccggcaggctgcgcatggtcagcatgatcgacatcctcggcgacgggctgtcgtccgtttacacgttcttcgagcccgacgaccagcacacgagttacggcacctacaacatcctgtggcagatcgagcaggccaagagcctcggcctgccctacgtgtatctcggatactggatccgcgagagcccgaagatggcctacaaggcgaacttccacccgctcgaagggctgatcgacggccgctggaagatactcgatccggatcggatcgacctgccgcccgtcgacgcggcactggcccgcgcgccattgccgggcggacattccggctcgggctgacgcgcgctgcgggggcgaggacgcgaagcgcgcccctgccgctcaactcccggtaaaatagcgggttgtcatccattccggctgtccgccctattcccgtgttcagttccctttatccgctggcccgcgcatccctgttcaagatggatgcggaagacgctcaccacctcacgctgcgcgcgctcggcgcggccggccgcacgggccttgcctgcgcgctgtcggcccgcgtgcccgacgcgccgcgcaccgtgatggggctcacgttccgcaacccggtcggcctcgcggcaggcctcgacaaggacggcgcggccatcgacggccttgcggcactcggcttcggcttcatcgaggtcggcacggtcacgccgcgcccgcagcccggcaacccgcgcccgcggatgttccgcctgccgcaggccgaggcgctgatcaaccggatgggcttcaacaatcacggtgtcgaccagttcgtgaagaacgtccaggccgcccgctatcggggcatcctcggcctgaacatcggcaagaacgccgatacgccgatcgagcgtgccgcagaggattacctgtactgcctcgagcgcgtgtacccgttcgcgagctacgtaacgatcaacatctcgtcgccgaacacgaagaacctgcgccagttgcagggcgcgggcgagctcgacgcgctgctcgcggcgctgaaggacaagcagcagcgcctcgccgacctgcacggcaagctcgtgccgctcgcgctgaagatcgcccccgatctcgacgacgaacaggtcaaggaaatcggcgacacgttgctgcgccacaagatcgaggcggtcatcgccaccaacacgacgctgtcgcgcgcggccgtccagggcctgccgcatgcggacgaagccggcggcctgtcgggccgtcccgtgttcgacgcgtcgaacgaagtgatccgcaagctgcacgccgaagtcggcagcgaagtgcccatcatcggcgtcggcggcatcttctcgggcgaggacgcccgtgcgaagctcgcggccggcgcagcgctcgtgcagctctatacgggcttcatctaccgcggccccgcgctcgtcgcggagtgcgtgaaggccgtcgccagcgaacgcgccgcgtaatataggcataaacaaacgatatttagaggccgattgcatttttgctatcatcggccctcattatcagaatcaatgacccggacagggcaaggaaacacacgatgaagattgcgctgctgaagaagctgctggttgccggcctgatcggcacgtcgctcgctgccgccaccgcgcatgcggccgacctcctcgaccaggtgaaacaacgcggcacgctgcgggtcggcctcgaaggcacgttcccgccgttcaactcgaagaacccgcaaggcgagctcgtcggcttcgacgtcgacatcgcgaaagccgtggccgcgaagctcggcgtgaaggcggaattcgtgacgaccgaatggagcggcatcatcgcgggtctgcaggccggcaagttcgacgtgatctccaaccaggtcggcatcaccgacaagcgcaaggaaacgctcgacttctcgccgccttacacgttttcgtccgcgcagctgatccagcgcaaggacgacacgcgcgagttcaagtcgctggatgacctgaagggcaagaagctcggcgtcgcgctcggcacgaactacatggacatggcgaagtcggtgcccggcatcgacgtgaagacgtacccgggtgcgcccgagtacctgcgcgatctcgcggccggccgcctcgacgccgcgctcaacgaccgcctgatgctcgcgtacctgacgaagaattcgcaactgccgctgcgcccgggcgcgaacgtcggctcggcgaacccgtcgggcatcccgttcaagaagggcaacccgaagttccagaaggcgatcgacgacgcgatggcgcaacttcaggccgacggcacgttcacgaagatctcggacaaatggttcggcatcgacgtgacgaaaccgatcaagtaagcacgcctgcatttccgcctgacggcgggccggaaagggcggcatccgtgacgatgccgccctttgttttattcgtccggtttatgattgcgctttcgcgcacgcattcgattcgtattccatgtcgacaacgtccctgctcgtccaatcgctgccggtgctcgcccagggtgccgtgctgaccgtcaagttcgctgtgctgtcgatggtgttcggcctgcttggcgccgtcgtgctcgcgatgatgagcatccggcaaagcgaagcgctcgacggcttcgaacgcatctgggtcaacgcgctcgcgtggctggcacgcgcgtacgtgagcctgatgcgcggcacgccgctgctcgtgcagatcttcgtcatctattacgggctgccgagcctcggcatctcgctcgacccgacgcccgccggcgtcatcgcgctgtccgcgaacgtcgcggcttacatgtcggaaagcatgcgcggcgcgatcaacggatcgcgcgcggtcaatggctggctgcgtacagcctcgggctgtcgtgggggcaaacgctgcgctacgtgatcggtccgcaggcgctgcgcatcgcggtgccgagcctgtcgaacagcctgatcagcctgatcaaggacacgtcgctcgtgtccgtgatcaccgtgaccgaactgctgcgcagcgcgcaggaagtgatcgcggcgacctatcagccgctgccgctttatctcgccgcagcggccgtgtactggatcctgtgccagatcctcgaatgggtgcagcgctggtacgaaaaacgcctgtcgctgccgtcgcggcactgagcaccggccgttcgccgggccgcccgcgtgcgcccggcgccttccttcccgcttactcgcccgaatagcgcacgccgagcgccgctcgcgcggcatcggtcatcgcgatcatctgccgcgaatgatcgtgcgtcatgatcgggctttcggtcttgcccgcgcgcagcaggtcgcagaagtgtgcggtctcgtagttcaatccgccgccttcagccggcgcgtcgagttcgacggtgcgcccgtccgcatagctgatcgtcgcgcgcaccgggttccaccacttctcgtgaatcgtcacgtggccgccggctgcggcgatcagcgcgtcgccacgccccatcacgtcgagcccgcaaaaagctgtgcgatcccgccgtgcgcatgcacgctgttcaggctcgcgaacaggtcgacacccgtcgcgccgacgcggccgagcgtctgtacgtcgagcgccgcaccgagccagtcgaccgcgagaaaggcctcgtagatcccgatatcgagcagcgcaccgcccgcgcgatcgaggcgatagacggaatgatcgccgggtaccgacgacgacgcgcaccctgcccgcacgagccggatctcgccgatcggatcgtcctgcaggtgcgcgcgcaactgacggtacagcgggaagaacggcggcttcatcgcctccatgaaaagctgcccggcgtcgcgtgccgcctgcagcacggtgtcgagctgcgccgcgttcagcgtcgcgggtttttcgcacagcacggccttgccggcggcaagcgcggccagcgtgtactgcgcgtgactgtcatggagcgtcgcgatgtagaccgcgtcgatatcgctcgcgaggagtgcttcgaggcttgcggcaggcgaaccgccgtgcgcgccgcaaaaggctgccgcggcgtctgcgcgacgggcccaggcaccggcgagcgtggcgcccggcacatgtgcgaggctttgcgcgaagcggcgcgcaatgctgcctgcgccgatgatgccgaagcgcaccgggcgatggtcgttgtcgttcatcctgatcttccgtgtcggtcgtatgacggtggccggcacgctgccggccggacgtcatgataaacggcccggcggcacacggatgagcgaaacgcgccgcgtcaggctcgcatgggcacgtcgacggagaagtcgcgcgagatctcgtcggcgctgaaatcgatcagcgcgagcgaagcggcttcggcttcgcgcggatcgcgccgctcgattgcgtcgaccacacgcgcgtgcgccttcaccacgacatcgtgcgcgccctccttctgcacgacacgcggattcacgaggcgcaccgcgccgcgtacgatcgccgccatctgctggaagaactggttgccgctcgcctggacgatccgcgtgtgcagcaactcgtccgccgtgtcgtagccggaatcgcccggctgcagcaccttgaatgcatcgaacgcttcacggatgccggcgatgtccgctgccgttgcgcgcaccgccgcctgcgcggtcgcgcgcggttcgatcagcatccggaattcgatgacgtcgcgcatgaactgcggatcgggtttcgcccggaagcgccagctcaccacgtcttcatcgatcatgcgccagtcgcgcatcggccgcacgcgcgtgccgactttcggacgcacgtcgagcatgtcgcgcgcaagcaacatcgacaacgcttcccgcatcacggtgcgactcacatcgaactctttcgacagcacgtcctgtggcggcaagatgccgccgtacttgtcttcgacgatacccgagacaagcccatccatcactttggcgaccagtgaccggtctttgccctgctccatgacacctccccgtgcgtcgatttgcgaacacctgctccgcagttccgccggccctggttacgactgttcttatgatctataagttgatgagttcgaggacatttcgctatctggtaaacacctgacagggttatccctcttttgacggggtgatttatacggctaaaaataaggcccgggaagcgcattgcgcctaccgggccccgaattccacaagatttaaacattcagttcattacggtacttggcacaccgttacggactgctttctatatctttcaattagccgaataaacgatcgtttcaacgccgttttccgtgccgagcaagcacagattcgcgccgcgctcggcgaacaggccgaccgtcacgacgcccggccatgcgttcacctgcgcttcgaagccgcgcgggtcggcgatctgcagccccttcacgtcgatgatctcgttaccgttgtcggtgatgtacggcgcaccgtccttcgtcacgcgcagcacgggcacgccgccgagtgcggtcacgcgccggccgatcgccgtgcgcgccatcggcacgacttcgatcggcagcgggaacgcgccgagcaccggcacgcgcttgctggcgtcagcgatgcagacgaacgtgtcggccaccgatgcgacgatcttctcgcgcgtgagcgcaccgccgccgcccttgatcatcgcgccgccggcgtcgatctcgtcggcgccatcgacgtacacctgcagcgagtcgacctcgttcaggtcgaacaccttgatgccgtgcgatttcaggcgttcggtcgtggcgacggagctcgacacggcgccgcgatagcgtgccttgacgacggcgagcgcgtcgatgaagcagttggcggtcgagccggtgccgacgccgatcacggcgccttccggcacgttctggatcacgtaatcggcggcggcctggccgacgaggcgtttgagttcgtcttgagtcatggagtggtaaagctgcgggattgcggaaaaccgccagtttaccggagtcggatggcggcccgcgtttttcggcgtgcggtgcgggttcagggctcacctgccgcaggcgcatagtccgcgggttgcgtgccggcgaagtacttgtcgagcaacgcctgcgcgatcgcatcggtttcggcgtccggatcacctgtgtagtcggccggcctgaaatgcatctgaaacgccgcgaacacgcgtcgcgtacgtgtgtcgagcacgccgtcggtggccacgtcgtagccgtagcgcgcgagcttgagctgcagttcgcgcacgtcgaccggcgcatgcggatcacgaccggcgagccgcgccgccacggtcggggcgtccggccacgcaccgacgccggcctgcgccaacgcgtgccacgggaacagcggccccggatcgatcttgcgttgaggtgcgatgtcgctgtgcccgaccacacgcgtcggcggaatcgcgtagcgcgtgacgatgtccttcgacagccgggtcagtgcggcgacctgctcgggcggatacggctgccaggtgcggttctgcggatcgagcgggccgcggttcacgttctcgatgccgatcgacaccgcgttcagctcggtcgtgccctgccactcgctgacgcccgcatgccatgcgcgctccgattccggaacgagctggtagacgacgggcagcccgcgctcgatgcgcggctgcggcgggatcacgtaatgcacgctgacggaatcgcccgtcagcgtgcgcagcgatttcgcctcgtcgctttcggtgtaatgcatcacgagaaagcggatccgcgaatcggcaccacgcgcgtgcaggctcgtgtcggcatagtaggtgccgcgttcgacgagcgtcggcgacgtgcaggcagccagcaggcacagcacggcgcaggacgcgcctatgcggaacaaggtcatcggtcgcgtgctccggagggccgcgtgccgcaccggatcgcggcacacgtcgttcgggtcattcgaggcccgcgcatgccgcacggaacgggctgcgtcagcccttcacgcgccgctggcgcacggcttcgtacaggcacacgccgcttgcgaccgacacgttcaggctttcgacgctgccggccatcggaatgctcatcacttcgtcgcaggtgtcgcgcgtgagccggcgcatgccttcgccttccgcgcccatcacgagcgcgacggggccgtcgagcttcgtttcgtagagcgttgccgaggcttcgtccgacgtgccgatgacccacacgccggcgtccttcagctcgcgcagcgcacgggcgaggttcgtcaccgtgatgtacggcaccgtatcggccgcgccgctcgccaccttggcggcggtcgcgttcaggccgaccgcacggtcgcgcggcgcgatcaccgcgtgcgcaccggccgaatcggcgacacgcaggcatgcgccgaggttgtgcggatcggtgacgccgtcgagcaccagcagcagcgcggggccctggatgccgtcgagcagctcggacaggttctgcgcgagcgggatgtcctcgacacgcgcgacgacgccctggtggcgctcggtatgcgcgaggccccacaggcgcgtttcgtcggccgcgatcagccgcacgcccgcttccttcgcggcgtgcaggaagtcctgcatgcggcggtcgcggcgcgtctggtcgtacagcacctccgcaaccgtcgatgcatcgtgccgcaaacgtgcggtcaccgcatgaaaaccgtaaagaaccttcagacgtgacatgactggaacaaccttcgatcaaacgtgcggccgcgcgacgcgcagccgcgatccatggaaaggaaagcgccgcgttgccggccgatgaccggtgacgcggcgtctctcgatactgcagggcgtgcacatggcgccgccccgaacgctcaatacttcttgcgggcgcgggtcttcttcgcggtcggcttcgccgccgcaccgccgccgccgttgccggcactaccgcccttcttcttcgcggcggcacgcgcggcgcgcgcgtcgttcaccgcgacgctcggcgcgctcgcggccttcttgcggcgcggcgcgggttcttccgcctgcggcagagcacggacacgcgggccgttacggtcgataccgccgccagccgaagccggcgcgggcgacgggcgcggcgccttcaccggcgtatcgcgcacgaggcggaagtcgatcttgcgcgcgtcgagatcgacacggctcacctgtacgcgcacgcgatccgacagacgatagcggatgcccgtccgttcgccgcgcagctcgttcttgatttcgtcgtactggaagtagtccgagccgagttcggtgacgtgcacaagcccttcgatgaaaagcgtgtcgagctgcacgaagatgccgaacgacgtgacgccgttcaccatcccgccgtactcctcgccgagcttgtcgcgcatgaagtagcacttgagccaggcctcgacgtcgcgcgatgcttcgtccgcgcggcgctcgttcgccgagcaatgcaggccgagttcttcccagatcgccgtattcgggcgcgagcggccgcgcgtttcgtcgtcggcctgctgcatcgcacgggcgcgcggcgacagcgcggtgttcagctcgaagccgtccggcgccttcggcacgtatttcctgccggacaggatcgcgtagatcgcgcggtgcgtgagcaggtccggataacggcggatcgggctcgtgaagtgcgcgtacgcctcataggccaggccgaagtgaccgatgttgtccgggctgtagaccgcctgctgcatcgagcgcagcagcatcggctgcagcatctgcgcatcgggccggtcgcggatctgcgccatcagcgccgcgtagtcgctcgcatgcggcttgtcgccgccgccgagcgacaggcccatgccgcgcaggaacgcacgcaggttctcgagcttctccggcgtcggccccgcgtgcacgcggtacaggcccggatgcttgttgcgcttcaggaaatcggccgcgcagacgtttgcggccagcatgcattcctcgatcagcttgtgcgcgtcgttacgctggcgcggcacgatctgctcgatcttgccctgcgagttgcagacgatgtaggtctcggtcgtgtcgaagtcgatcgcgccgcgcttctgccgtgcggcgaacagcgacttgtagacgccgtacagatcctgcaggtgcggcagcaggtccgcgcggcgcgcggcctccggccccttcgtgttcgacagcacggccgcgacttcggtgtacgtgaggcgcgcagccgaatggatgacggccgggtagaactggtacgccttgatctcgccgcgcccggtgatcaccatgtcgcacgcgagcacgcaacggtcgacctgcggattcaacgagcacaggccgttcgacagcttctccggcagcatcggaatcacgcggcgcgggaagtagaccgacgtgctgcgctcgagcgcgtcggcatcgagcgcgcttccaggttgaacgtaatgcgacacgtcggcgatcgcgacgatcagccggtagccgtcgccgcggccgaccttcaccggctcgcagtagacggcatcgtcgaagtcgcgtgcgtcctcgccgtcgatcgtcacgagcggcacgtcgcgcaggtcgacgcggaaacgcaggtcggtcggccgcaccttgtcgggcagcgcggcggcttcgtcgagcgccggctggctgaattcgtgcgggacgccgtacttgcgcaccgcgatttcgatttccatgcccggatcgtcgatgtcgccgagcacctcgacgacacggccgagcggctgcgaatggcgactcgggaaatcggtcagctcgacgacgacgacctgcccgaccttcgccttcttcacgttctgcgtgatcaggatgtcgtggccgatgcgcttgtcttccggtgcgacgatcagcgcgccgttctcgttgagcaggcggccgatcacgcgcttgttcgcgcgctcggtgacttcgacgacgtgcccttccgggcggccgcggcgatcgtagccgacgatccgcgcgagcacgcgatcgttgtgcatcaccttctgcatttcgccgttcggcaggaacaggtcgtcctggccgtcgtcgcggatcacgaacccgtagccgtcgcgatgcccttgcacgcgcccggcgacgaagttcgacggatgggtcaactggtagtggccgcgcttgtcgaggcggatctggccgtcgcgctccatcgcggcgacacgccggaagaacccctcgcgctcctgacgcttgatcgacagtgcttcggcgatgtcgttggcggccagcggcgcgtcgctcgtacgcagcacgccgagaatttcttcacggctcggaatggggtacggatatttgctcaagggtttgtcgatgattgttctcgttgcgttgactgatggtgcacggcatcaacatagaggtgtccttcagacagttctatattgacggcggcgggtcattctatcacccgcctgtgtcgccaaatgacggggaatgccgcccgcaggcgcggcggagcccggtttgcggtgcatcgcaaaaagtgttgacacgattaattggggcgctataatttcgcttctttgcagcaagcagctactgcaaaacgtgcccaggtggcggaattggtagacgcactaggttcaggtcctagcggtggcaacatcgtggaggttcgagtcctctcctgggcaccatctgttttctaaaaggtcggcttctagccgacctttttcatttcaagcccaggaagcaaagcacctgcgcgctttgcgcgaggactcgaaaggctgcgcttgcaagcgcagccggggtcgcgcatgtgtgaccgagtcctctcctgggcaccatctgtttttgaaaagatcggcttccagccggcctttttcattctcagcgccaggaaacaggcgcccggcttactcgccgatgaacttgcgcaacagccgggtcagctcgtcgaactcggacttcgaaaatttccgcaagcgggcattgagcaccttcggcgcaatctccggaatctgcgcggcaaccgcctgccccgcttcggtcagcgcgaggttcaccacccgccgatcgctcacgctgcgcgaacgctcgacgagccccttgtcctccagcttgtcgagcacgcgcgtcatcagcccggtgtcgacgccgagcagcttcgacaattcgaaaggcgtcgccgcgctgccggtccgcagggacagcaggatgcccatctgctgcgccgtgatatcgagatccttcaacgccgcatccatctcggacgtgatcaggttgcgcgctttcacgagcacaaaccccacgctttcggtgtgcaggaaattcttcggcgtgtagtgttccatcgtgctcgctgagtcgcatattgttgacccacacaataattgcgacatcacgatttttcaagacacgcggcatcccgcatacgcgccgcccgcgccggctcagtgcccgccggccgccgcggctccggctgccaccccttgcccggcttcgtcacccagaccagcgggatgatcagcacgaagatcaccgacgacagccagaaaacgtcgttcagccccagcatcgtcgcctgcgcattcaacgtcgtctcgaggaacgtcagtgccttcggcgcaccggcatcgagcgcgctctgcacgccggcaaccgcgctcgcgaagatcggattgttcacactgccctgctcggcgagttgcgcgtgatgcaggatcgtgcggtcgttccaggcggtgctcgcgagcgacgtgccgaccgcacccatgaagacgcgcgcgaaattggacaggccggccgccgccgggatgcgctcgggcggcagccccgacaggatgatcgacgtgagcggcgtcatgaagaacgccgtcggaatgccctgcagtagcgtcggcaccacgagcgtccatgtatcgacgcccgtcgtatagcgcgagcgcatgaaaaacacgccggcaaacccgagaaacgccaacgtgacgagcacacgcatgtccgatttcggcatcaccttgccgaccatcggcgcgaggatcaccgcgaagataccgagcggcgcggtgacgaggcccgcattgaccaccggataaccgagcgagccctgtatccattgcggcaggatcacgaggttggcgaaaataccgcgaacgcaatcgaaatcgccaccgttccgccgaggaaatttcgttgtgcaaacagcctgagatcgacgatcggacgcgcctcggtcaactcccagatcaggaagaacacgaagccgaccaccgccacgatggtcaggatccagatcgtcgacgaattgaaccagtcgagatccttgcccttgtcgagcatgacctgtagcgcggcgacccacacgaccagcgcgatcagcccgaccttgtcgatcggcagcttgcgggccggcgtttcccggttgcgatagagcgcccagatcacggctgccgcgaacaaccccacgggcacgttgatgtagaagatccacgaccagctgtagttgtccgtaatccagccgccgagcgcggggccggcaatcggcccgactgtcgccgtcatccccacagggacagcgcgctcgaactcttctccttcgggaacgacgccagcagcaacgcctgcgacaacggcacgagcggcccggccacggcaccctgaacgatccgggcggcgaggagcacggtcaggttgggcgcgagcccgcacgcagccgacgacagcacgaacagcaggatcgcgcagacgaacagcctgacctgcccgacccgctgcgtcagccagccggtcagcgggatcgacaccgcgttggccgccgagaacagcgtgatgacccacgtgccctcgtcgatggacacgcccagattgccggaaatggttggaatcgcgacattggcgatcgacgaatcgagaacgttcatgaacgtggcgagcgccactgccagcgttcccagcataaagcgggcgccggtcaggggcgccggcgtacccggactttcggacggcttcatcggatgcccttctgatcgggcgccacgcgaacagccccggcgccgagcaaaattaactgacaagtcagataagtgattgaaaaagcgatcgacgtgccgcgcgggtgttgctcacgcttacgtcaatcactgacttcgatatttctgcgccgactatatttgactatgcaatcaaatgcaacccgaaggcatcgatcgaccgcacatgcatggacgcgccgcgatcacgggcggccccgcccttatgcccgccagcaggatcgatagcagaatttatcggttatcgtccgctcgccctgttggtacgttagccggctcgcttcaatgcaacgaaccagacaaggagcacgatccatgacgccgatgaaccgccgcgcattcgcgcgcgcgatgctggccgcaggcctcactgccgccggcgtccgagtgcgcgccgagaacgcacccgatgctgcgcatcggctaccagaagtcgtcgacactcatcacgctgctcaagacgcgcggcgcgctcgagcaggcgctggcgccgctcggcttgcgcgtgtcatggcatgaattcgcgagcggattgccgctgaccgaagcgctcaacgtcggcgccgtcgatttcagcgccgacgtggccgatacggtcccggtcttcgcacaagcggcccatgcgcgtttcgtgtacgtcgcacaggaagcgccttcgccgaaagcgcaggcgatcatcgtcaagcaggacagcacactgcgtacgctcgccgatctcaagggcaggcgcattgcggtcacgaaggcggccggcagccattacctgttgcttgccgcactcgcacgcgcgaagctcgggccggccgatgcgacgatccactacctgacgcccgcggacggccgcgcggcgttcgagcgtggcagcgtggacgcatggatcacgtgggatccctatgtcgcatcggtcgaccgcaatcccgacgtacggattctcgccgacggcaacggactcgcgtcataccagcgctactaccttgcgtcgaccagcttcgccactgcgcggcccgacgtcgtccagatcctgttcgaccagttgtcgcaggccggcacgtggctgcgcgaccacccgcaggacgcagcgaatacgcttgcgccgatctggggctcgacgcggcgacgatcgcgcgcgcgaacgcgcggcgcagttatctcgttcgcgccgtggtcgcgcaaaacttcggcgaacagcagaagatcgccgacacgttcctcgcggccggactgctgccggcgcgagtcgacacgagtcaggcgcagcgctggaacttcgacgcgaaacgcgcgattccggtcggcgcgtgagaatccgtcgcacgaggggcaatatttttatcgctttgaatgaaattgtgttgacaggctgcgccgacacgctagaatagcggtcttcgcatcgcagcaagcgaaacgtgcccaggtggcggaattggtagacgcactaggttcaggtcctagcggtggcaacatcgtggaggttcgagtcctctcctgggcaccatctgttttctaaaaggtcggcttctagccggcctttttcatttcaagccctggaagcaatgcgcttgcttgctccgagcggggcgtcgaagggctgcacttgcaagcgcgactcgggttacacatgtgcgacccagccccttccgcccgactttccacttcctaaaaagctcgttccagtcggcccgcctgcattcccggcatctggaagggatcagcccgcgcgcatccgcccatcacaagttcgatgatgcacgtcggtcgactgccgcgatgtttgcgcacctcgctcgatgcccaaacaaatccgtcaaattattttcgttcgcgacctcaaatcctgttgacagccgccaaagacgcgctataatttcgcttctttgcagcaagcagctactgcaaaacgtgcccaggtggcggaattggtagacgcactaggttcaggtcctagcggtggcaacatcgtggaggttcgagtcctctcctgggcaccatctgttttataaaaggtcggcttctagccgacctttttcatttccggctcaggaaaacctcctcctcatcttcgcgagcagacccagtcgcttcgatttgcgccgccagcgcaagcaaaccgcgacggcatgctgcgaatccggcgacaacccactaccccgggttcatgccaccacccacgccaccttccgcctgaatgaccgggcttccgcgatccatcctcgattccggacgccccgcattaccatccccgcccccacctcaaaccgggatttccctaggctgacatgtcggcgttcacgcggttaaataaatcaacgtgatttatttaatgcgccgctgcacggcgcgccatggaaggagacgccatgagaagcccgcacttcggccagggcagcaattcggccaacgtgcgccgttacaacgagcgcctgctgctgaagacgctgcgccgtgcaggcagcgcgtcaaaggccgacctcgcccgcctcgcgaacatgacgggcacggcggtcggcagcatcatcacatcgctcgccgacgcgaagctgatcgaattcgcgggccgcaccgaaggccagcgcggtcagccggcttcgctgattcgcctcgacccgcgcggcgcgttcggcatcggcgtccatctcgaccggatgcgcatcgaaacggcgctcgtcaacttcgcgggcgacgtgctcggccgccgctcgcacgacacgctgctgcccccgcccgccgacgtgctcgagatcgtccgccacgacatcgaagcgatgcaggccctgctccccgaccacgagcgtgcccgcctggccggcatcggcgtcgcgcagccctacaacctcggcgcgtggatgcgcgaactcggtctcgcacccgacacgtttcgcgcgtgggaagacgtcgatttcgcaagcgacctcggtcgcatgctgtcgcttccggtattcggcgaaaacgacggcaacgcggccgcgatcgccgagctcttctacggatacggccggcagtgcgacgatttcgtctatctgttcatcgggcccgcgatcggcggcggcatcgcgatcgacggcgactgcctgcgcggcgtgaccggcaacgcgggcgacatcgccgtgattcccgtgcagccgagccggctcgcttccgcgccgccgccgcgtggcccgtgggacatcctgctcgcgcgcgcgtcgctgcatgcgctcgtgcgccatctgcgccatcacggcgagacggtcgacaaccgggccgatctcgaagcctgcatcgctcgcggcctgcccgccgtcgacgaatggatcgacgattgcgtcgacgcgctcgcacctgcgttgcgcgcggtgctgtgtgtgtcgatgcgccggtggtcgtgctcgacgccgataccgacgcaggcctgctcgacgcggtgacaacgcgcctgcgtgccgcgctcgtggccaccgcgcccgaagcgcgcggcacgccggtgctcgtacgcggcacgttcggcgccgacgccggcgcgatcggcgcagccacgctgccgatgtatttcaacttctccccgcgggccggcatcctcaagggcgcccgcaccgactcgcaggaggtcaaccatgtcgcgatctgagtcgccccgtccgctgctcgagatgcgcgggatcagcaagacgttcccggccgtgcgcgcgctcgacaacgtgagcctgaccgtctatcccggcgagatccactcgctgatgggcgaaaacggcgcgggcaaatcgacgctgatgaaaatcctgtcgggcgcataccgcgccgacgccggcggcgagatcctgatcgacggcgaacgcatcgacatcgacggcccgcttgccgcgcgcgatgcgggcgtcgcggtgatctaccaggagctgtgcctgtccccgaacctgagcgtcgcggaaaacatctacatcggccgcgaattgcggcgcggcaaccggcgctggggcacgatcgaccgcgcggcaatggcacgcggctgcgaggacgtgctcgcgcgcctgggcgcatcgttcgggcccgacacgctcgtcggcacgctgtcgatcgcggaacagcagctcgtcgagatcgcgcgcgccgtgcacacccgcgcacgcatcctcgtgatggacgagccgaccacgccgctgtcgtcgcgcgagaccgaacacctgttccgcctgatccgccagttgcgcgaggaaggtctcgcgatcatctacatcagccaccggatggcggagatctacgagttgtccgaccgtgtgtcggtgctgcgcgacggcacgtatgtcggcacgctcgagcgcgcatcgctttcggccgagcgtcttgtcgcgatgatggtcggccgcgacatctccggcttttacaagaaggaacacgcgccgtacgaccccggccacctgctgctgtcggtacgcgacatcgctgacggcgcgcgcgttgcagcctcgacctgcacgccggcgaagtgctcggcatcgcggggctcgtcggcgcaggccgcaccgagctcgcgcggctgatcttcggcgccgaaccgcgcgtgcgcggcaacgtgaaggtgggcgaacgcacgttcggcgcgcactcgccgcgcgacgcgatcgacgccggcctcgtctacctgaccgaagaccgcaagcgccagggcctgttcctcgacatgagcgtacgcgacaacatcaacatctcggtctgcaaccgcgatgcgcggctcggtgcgctcgacctcgcgcgcggcgccgaacgtgcacgcgacgcaattgcatcgctgtcgatccgcgtccccacgcgaacgtcaacgtcggcgcgctgtcaggcggcaaccagcagaaagtgctgctgtcgcgcctgctcgaaacgaagccgcgcgtgctgatcctcgacgaaccgacgcgcggcgtcgatatcggcgcgaaatccgagatctaccggatcatcaacgaactggcccgcgccggcgtgggtgtgatcgtgatctcgagcgaactgccggagatcatcggcgtcgccgaccgggtgctcgtgatgcgcgaaggcgagatcgcgggcgagctcggcggccacacgcatacgcccatcacgcaggaagccatcatcgcgctcgccaccggctcgcaggccgaactcgccgacgcgcactgagcccgccctttcagttcactcttacattcaggttaccgacatgatcaacccgaccaagcagcggaacctcgcttccgcgacggcccatccggtgggcaaccgtacgccgctgttgcgcggcgccgatcaccgcgcccgcatgcagtcgctgatccgcaccgccggcatgctgccggtgctgctggttctgtgcatcggcttcggcttcctgaccgacggcttcttcacgctgcagaacctgtcgatcgtcacgcagcaggcgtcgatcaacatcgtgctcgccgccggcatgaccttcgtgatcctgacgggcggcatcgacctgtcggtcggctcggtgctcgccgccgcggccgtcgcggcgctgctcgcgtcgaccattccgggctggggctggctcggcgtaccgttcgcgctcatcgtcggcctcgtgttcggcgcgatcaacggcggcctgatctcgttcctgcgcctgccgccgttcatcgtcacgctcggcgcgatgacggccgtgcgcggcgttgcgcgcctgatcggcaacgacacgaccgtgttcaatccgcagttgccgttcgcgttcatcggcaacggcacgatcctcggtgtgccctggctcgtcgtcatcgcgtgcgcggtcatcgcgatctcgtggttcatcctgcgccgcacggtgctcgggatgcgcatctattcggtgggcggcaatccggaagccgcgcgcctgtcgggcatcaatgtgcgggcgatccagatgttcgtctatgcggcgtcgggcctgctcgccgggctcggcgcggtgatgtcggccgcgcggctttatgcggcaaacggcctgcagctcggccagtcgtacgaactcgacgcgatcgccgcggtgatcctcggcggcacgagcttcgtcggcggcgtcggctcgatcgtcggcacgctgatcggtgcgctgatcatcgcggtactgacgaacggcctcgtgctgctcggcgtgtccgacatctggcagtacatcatcaagggcctcgtgatcatcggcgccgttgcactcgatcgctatcgccagcgcgactcggcgcgcacctgacccttcccgtcgattcaaccttgcggcgctggccggttcgcctgcgcccgttcaccaacaaacctctcggagacacaacgacatgctcaagcacaaagccgccctgaccgccgtcgcctgcgcactcgccttcggcgcttccgccgcacacgcggccgacaagccgctcaaatcgatcggcgtcacggtcgggtcgctcggcaatccgtacttcgtcacgatcgtcaagggtgccgaggcacgcgccaagcagctcaatccgaacgcgaaggtcacggccgtctcggccgactacgacctgaacaagcagttcacgcagatcgacaacttcatctccgcgcacgtcgacatgatcctgctcaacgcgacggatccgaaggcgatcgagccggcggtgaagaaagcgcaggcggccggcatcacggtcgtcgcggtcgacgtcgccgcggcgggcgcaaacgcgaccgtgcagaccaacaacgtgaaggccggcgaactcgcgtgcgactacatcgtgaagaaactcaacggcaagggcaacgtgatcatcgagaacggcccgcaggtatcggccgtgatcgatcgcgtcaacggctgcaaggccgtgctcgcgaaaaacgccggcatcaaggtgatgtcgagcgaccaggacggcaagggttcgcgcgaaggcgggatgaatgcgatgcaaggctacctgacgcgctttccgaagctcgacgcggtgttcacgatcaacgacccgcaggcgatcggcagcgacctcgccgcgaagcagctgaaccgtccgggcatcgtgatcacgtcggtcgacggcgcacccgacatcgaggtcgcgctcaagtccaacacgctcgtgcaggcgtcgtcgagccaggatccctgggccatggcgcagcaggcggtcaacgtcggctacgggatcatgaacggccagaagccggccaatccgatgatcctgatcgagccgacgctcatcacgcgcgacaacgtgaagacctacaagggctggagctcgccgcgctgatcgcgccgcctgtccgcccacgcaaccgggcggtgccgggccgtgtcgccatgcgcgacggccccgcactgcccgccttttcggatcaaccgctgtacggccgtgcgcaacgccacggcacaaggtttcgacatgacgacgacgttccccgcctgatcgtattcggcgaagcgctgaccgatttcatccgcgacgacgcgcagcactggcacagcgtcgccggcggctcatgctggaacgtcgcgcgcgtcggcgcgcgactcggcgtgccgacggccttcgccggcacggtcagccgcgacatcttcggcgacgaactgatgcgcaagagtgccgacgccgggctcgacctgcgcttcatccggcaggtcgatcgtgcgccgctgctcgcgatggtcgtgtcgaagcagccgccccactatttcttcatcggcgagaacagcgccgatctcgcgttcgatccggcggacctgcccgccggtgcgctcgatgcggccgagatcgtgcacgtcggctcgctcggcgtcgtgcgcgagccgctcgcggcgcgcctgatcgaagtcgcgcaggccgcgcgaacggccggcaagcgaatctcgttcgacccgaacttccgtgcgccgatggccgcgccgtcgtatcgcgacacgctgcgccggctggccgggctcgccgactggatcaaggtgtccgacgaggatttgcggggctgtttcccgaactcgatgaagccgccgcgctcgcgcaactgcgcacgtgggcgcccgacgcaacgatgctcgtcacgcgcggcgcatcgggcatgcagctcctgcatcgcgacaccgtgctgttccagcccgcgttcccgaccgaggtggccgacaccgtcggctgcggcgacgcgagcatcggcggctggctcgcgagccagctggcgcgtcccgacgcgtcagccgccgagcatctgcgctacgcggccgcgtgcgcggcggtcgcctgtgcgcatgcaggcgcctatgcgccgaccgcggccgaggtgaacgacatgatcgatcgcactaccgacgctgcagtttcgcaatagcacctaccggcgcaccgcaccgtcacgcggtggtcgttccgccgctgccgtccggcggggtcccggcctgcagcagctgcaggctctcgtcgacgctcagttcggacatcgcatcgtcgtgaagcgtatcgtccgccgcgcggcgcaatgcatgcagcgtatgcaccttgagccgcacgagcgcgagccgcaacccgcgcgccgcgcattcggccgcaaaggtgcgcaacgattcgatcgtcgtgccgtcgacatccggcgtttcctcgaggctcagcatcacggtatgcgtgtccggcgcggccttcatcaacgcacgcacacggttcaacatccggtccgcattcgcgaagaacagctgcgcctcgggccgcacgatcagcacgcccggcaccggcttcgcgtcggcgtggctcgcgacgtcgacgaaatcatggctgtcgcgcagcctgccgagcacgctgacgttcggctcggacaacttgcgcagcgtcagcagcaggctcacgccgatggccgcgagcagcccgtgcagcacaccgagcacgagcaccgcgagcagcgcggcgatcacgacgagccggtcgcgatgccaggcccagtacggccggaacaccgacggatgcagcgagtggctgaccgcgaagatcacgatcgccgcgagcacgggctccggcgtgcgcgcgagctgcggcagcagcagccacacgatcagcgcgaccacgcccgccgcccacaggcccgcgaagcgcgactgcgcgccggccgcttcgttcgccgaggtcgccgaatacccggcgccgaccggcatcccgtgcagcaggcccgacacgagattcgcgcagccgagcgcgacgaggtcgcggttcggcgacacgctgtcgccatgcttcagtgcgaagttgcggatcgatccgtacgactccgcatacaggatcagcatcagcgcgaacgcaagctcgacggtctgcatccacgcgttgcggtcgagggtcggcaggccgaactcgatatgccggaagtcgatgtggccgacgatcgcaatgccgtatcgctgccagtcgaccgcataaccggccgcgatcgacagcacgatcacgacgagcgtcgcgggcacccgcgtgctccgtccgagtgcgaacagcaacgccagcgcggtcgcgccgagcacgacgctcgcgagattcgcgtgcggcgcaccgctgatcaggtcgagcgcgacatgcggcgcatcgctgtgctgcacggaaatcgcgagaatcttcggcaactgcttgatgacgatcgtcagcgcgaggccgaacgtgaagccgcgcagcaccggccgcgcgacgaaatccgacatgccgccgagccgcgcggcacccgccaggatgaacagcacgcccgtcatcgcgacgagcgccgccgccagcgcgagctgcgcggcaagcgccattcccgactccgcgagcacggtcgccgcgagcacggcagccgacgacgacgtcgacgacacgatcgcgaaacggctgctgccggtgagcgcatagacgacgagccccgacagcaacgcgatgagaccggcctgcggcggcaggttggccagcccgcgtacgcgaccgcctcggggatcagcaagcccgcgatcgacaggccggccagcgcgtcgaggccgatgcgccgcgtcggcggcggcgaggccgcgtcgagcgcggagaaatgctcggcatgctgcgggccggcatcggggcggatcggggcagtcgtcatgaggtgctcagggcctgacggcgatgacgcccgaccagccgggcagatagcgtgcatcctgctcgtgcgcgcgatgcagcgcgatatcgagcgccttcgcgaagttcttgcggatctggtcgagcgacacgtgctggcgcaggtagtcggcccacaggaattcgctgaacggcgtcgcgtccttcgcgtagccgcccgcggtgcgcagctcgccggcgaggctgcggtacggatcgtccacgagcgccgtcagcaccttcggcagattcgcgtagtcgcggcgcgtgccgtccgcgccgaacggatgcacccactggttgtgttccatcatccgccagaagatcgtgtcgtcgagccacgacaggtccttcagcagcatcgcgttcacgcgcgcctcgccttcctcgatcagtgcgaggccgagatgatgatgatcggtgatgtagtgcagcccgcccgggccgagcacggccgggaaccagtgcgattcgatcgcggtcttgcgcgcgcgcttgctgagccccttccagtgcttgcgcttcgccttgacttcgcgatagccgaccgtcatctgcgtgggacgcagttcttccagcttgacgggaatcaggtgaacatcggtgccgagtgccatggtcgtaccccatgttgcgaaattccggcaacgatactcctgaacgcacgagccgttaatacgtcatgacctcgatacgcatccggttgacgatccacgacaactgcccgtgtacgcacgcgccgcgctacacgcgcaggtcgttgcgttcgagacgatgtcgaatgtagggaatgccatcgtgcacgacgctcacccggcgcatcccgagcttgcgcgcgacgttcaacgagccgccgttggcctccgcgatatcggcgatcacgcgcggcaggcgcacggtgtcgaaggcgtggcgcacgacggccgacgcggcctcgctcgcgatgccgcgcccccatgttgcacgcaccagccgccagccgatctcgacatcgcgcgcgccatccgcatagtccggaatcagcaggatccagccgatgaacgcatcgggcgcggccttctcgaagatcgaccagtagccgaggcccggcggatagtcgcgcgtgatccggtgcgtgacgaagcgccgatgctcgacgggatcgtgccacgggcccgcgatgtgccgcgtgacctcgggatcgcgatccatcgcgatgcaggcatcgagatcggccagtacgcgcggacgcagccacagccgcgcagtttcgagcacgggcagcgtggcggcggaaggttcagtcatctggactcctgattcggtgacgatgctcaccggacgcattacaaaacagatacaaacagccttccggaatgatacagaggcctgccgccggtttcgcgcagcgccgttgccgaatccgaaacagttcatttcctagggattattcccgattcggcgttatcgcgccccacatcgccaagcgccgcggcctacactcgatccatgcccccgcaccgcgcgcaagccgggccggcatccgcatgcacatcgtaagcgcgcaagccaacgaggagacttcggacatgagctggacccgcgaacaacgcaacgtgacgatcgccgcctacctgggctggacactcgatgcgttcgatttcttcctgatggtcttcgtgctgaaggacatcgccgccgaattcggatcgacgattcccgccgtcgcgttcgcgctcacgttgacactcgcgatgcgtccgcttggcgcgctgatcttcggccggctcgccgaccgcttcggccgccgcccgacgctgatggtcaacatcgcgtgctactcgctgctcgaactcgcatcgggtttcgcgccgagcctgaccgcgctgctcgtgctgcgcgcgctgttcggcgtcgcgatgggcggcgaatggggtgtcggctccgcgctgacgatggaaaccgtgccgacccatgcacgcggcttcgtgtcggggctgctgcaggccggctatccgagcggctacctgctcgcgtccgtcgtgttcggcctgttctaccagtacatcggctggcgcgggatgttcatggtcggcgtgctgcccgcgctgctcgtgctgtacgtgcgcgcccacgtgcccgaatcgccggcgtggaagcagatggagaagcgcccgcgcccgagcctcggggccacgctgcagcagaactggaagctcacgatctacgcgatcgtgctgatgaccgcgttcaacttcttctcgcacggcacgcaggatctctatccgacgttcctgcgcgaacagcatcatttcgatccgcataccgtgtcgtggatcacgatcgtgctgaacatcggcgccatcgtcggcggcctgtcgttcggctcgatctcggagcggatcggccggcgtcgtgccatcttcatcgctgcgttgatcgccctgcccgtgctgccgctgtgggcattctcgagcggcccggtcgccctcgccgcgggggcgttcctgatgcagatctcggtgcagggtgcgtggggcgtgatcccggttcacctgaacgagatctcgcccgacgagatccgcgcgaccttccccggcgtcgtctaccagctcggcaacctgctcgcgtcgggcaacgcgacgatgcaggcctcgctcgccgtttcgcacaacaacaactacagcttcgcgctcgcgctcgtggccggcatcgtcgccgtcgtgatcgccgtgctgatcctgttcagccgcgagcggcgcggcatcgacatgacgcaatcggtcaatacgcgtagcacggtcgcctgatcccgcgtattgccgcattgcaccatcgcgcgtgccccgccctgtcgaaggcgcgcgcgatactttccgcattcgcacatcgaactagaggaatttgtccagattccccgcttgcccgctccgctcgccctttttatcttaataaaaacgactgtttgaatcagataatcaaatcaccagttcgcggccgggcgaccggcatgggaggcgggacatggcagtaagtcaggaggggcggccatccgcgggacggccgtccggggcacggtcatccggcactcggcagaccggcgggacgaaggcgcgcatcctcgatgcggccgaggacctgttcatcgagcatggcttcgaggcgatgtcgatgcgccagatcacctcgcgcgcggcggtcaacctcgccgcggtcaactaccacttcggcagcaaggaagcgctgatccatgcgatgctgtcgcgccggctcgaccagctcaaccaggaacgcctcggtatcctcgaccgcttcgatgcgcaactcggcacgcacatcacctgcgagcacgtgctcggcgcgatgttcattcccgcgctgaaggcatcgcgcaatcccgaacgcggcgggcccgggttcctgcggctgatcggccgcgcgtacaccgatccgtcgccgttcgtgcgcaacttcctgaccgcgcactacgcaagcgtcgcgggccgcttcttcgacgcattccagcgcgcgttgccgcacctgccgcgcacggagctcggctggcggctgcacttcgcgatcggtgcactctccggcgcgctcgccggcgccgaaacggaaagcctgatcgacgagttctcgcaaggccgcacgatgaacgacgtgcagatgatcgcgcggctgtcgtcgctgatcgtcgccgcgctgaaggcgccgatgcccgacagcgcgcaactgtcgatcttcgcggccgtgctcgacgatgcaggcgcaagcgaagcgttcgggctgccgtcgtcggccgcggccaccgccgatacgacgacgctgcattccacgaactgagcgcgcgaggccgcgcgcggcttcctgttcacgatttgattgaaacgcgcggtcatgcggagcgccgaggcgccccgccgatcgaccgtgcggcacggggcacgggccggcgctgaagcgccggccttcgccgagagcaaagaccggagacatgtcatgtcatcttccgcagcaaccgcagcggcccaggttccgccgaacaccgacggcatctggtacgcgtcatatccgcccggcgtcccgcacgacatcgacgtcacgcaatacgcatcgctcgtgcagttcttcgacgagtgcacgagccgcttcgccgagcgcgtcgcctatgtgagcgcgggcgcatcgatgacctatcgcacgctcgcgcagaaagtcgacgcgttcgcgtcgtatctgcaaagcctcggcgtcaaacccggcgaccgcgtcgcgatcatgctgccgaacacgttccagtacccggtcgcgctgttcggcacgctgaaagccggtgcgatcgtcgtcaacgtcaatccgctctataccgcgcgcgaactcgcgcaccagctgaaggacagcggcgcgcagacgatcgtcgtgttcgagaatttcgcgcgcacgctgcaggatgcgctgccggaaacgcaggtgaagaacatcgtcgtcaccgcgctcggcgacctcctcgccgacggcttcaatgcgaaaggacgcctgatcaatttcgtgctgaagcacgtgaagaagctcgtgccggcctaccacctgccgcaggccatccggttgcgctccgccctcgcgctcggtgcgcgaagcaagccgcagcccgtgcagacgacgcgcgacgacctcgcattcctgcaatacacgggcggcacgacgggcgtcgcgaaaggcgcgatgctcacgcacggcaacctgatcgcgaacctgctgcaggcgaaggcctggatcgccgaccaggtatcgggcgacgtcgaaaccgtgctcacgccgctgccgctgtatcacatctattcgctgacggtgaacgcattcatcttcatggggctcggcgggcgcaacatcctgatcgcgaacccgcgcgacatgacgatggtgatgaagatcatccgcaacgagacgttcaccgggatcaccggcatcaacacgctgtacaacgcattcctcgacaacgaggaattccgcaagcgcgatttctcgaagctgaagctcgcgatggcgggcgggatggcgatgcagcgtgcggtcgcggaacgcttccagcaggtgacgggccggccggtcgtcgaaggctacggcctgaccgaatgctcgccgatcgtcacgatgaaccccgtcaacctgaacgacatggccgcgttcagcggttcgatcggcctgcccgcgccgtccaccgtcgtgcgctttcgccgtgaggacggcacctgggcgcccgtcggcgagccgggcgagctgtgcgtgcgcggcccgcaggtgatgcgcggctactggcagcgccccgacgagacggccaaggtgatcgacgccgacggctggctcggcaccggcgacatcggcgtgatggacgaacgcggcttcatccgcctgatcgaccgcaagaaggacatgatcctcgtgtcgggcttcaacgtgtatccgaacgagatcgaggaagtgctggtgatgcatccgggcatcagcgaagccgcggcgatcggcattccggacgaggtacagggcgaacggatcaaggtgttcgtcgtgcgccgcgacccgtcgctgacgaccgacgatgtgctcgcgcactgccgcaagaacctcaccggctacaagatgccgaaattcgtcgagttccgcgacgcgctgccgcagacgaacgtcggcaagatcctgcgccgcgcgctgcgcgacgaagaactcgccaaaatcaaggccgcgaagcaaggttgaacgatccgtcgcccagggagacgccgtcgatgaacgaaggaaagaagcaccacgcgcggcatgccgccgccgtggcagtcgcctgcctgctgtcgctcggacaggcgggcctgcatgcccaggaaacggccgatgccgcaagcgcggccgcgggcatcgcgctgccggcggacctcgcgaaagtcgcccgcgagccggtcgcgcagcaggcgcgctggctgcgcacggctgcacagcgcggcacgctcgcgcaactcgacgacgcgacgctcacggcgctcttcaaggcactcgatccgctcgccgtgccgctctatatccgtaacggccccaacggctatccgtcgtaccagttcacgatggtgcgtcaggagcgcatcagcggaaagtggtccgatacgcccgaccgcatgctcgtgaagaccacccgcgagccgctgcgcgtctatgcgaaatggctgccgggcggtgcgcatgccggacaggagaccatctacgacacgacgcagcgcaaggacgagatgtacgggcacctcggcggcctgctcggcaagattccgctgtggacggcactcgacggcgcactcgcacgcgcgcagtcgaatcaccaggtgaaggatctcggtaccgagttcatcacgaacctgtacctgaccgaagggaagaaatacgtggaagccggcgtgcagcggccgaccgacgtggaggccaggacgatcggcggcgtgcgcgtggtcgcgctcacctacgaaacaccgaccggccggccgcagttctacgcgaagaaggaagtcctcgggctcgatctgcacgcgccctatttccggaccgtcgagtcctatgacaacgacggcaagatcttcgagcggatcgtcatcgagaaaatcgcgccggcgacgctcgacgacaccgcattcgacccgaaaaaccccgactacgcgttctgatgcacgccggcggggctggcctcggctcaatcgtcatcgtcgccgccgtggtgccggtgccaatgcttgtaataatgcttgcgccacttgcgatagcgatcgtcgtcctcgtcaccgtagtagccgtatccatagcccggataggcgaccacggccggctgcggcgccacatagaccggcgccggctcgacatagaccggcgcgaccggtacgccgatgccgaccgacaggtcgacatgccccgccatcgcactgccggaagccagcaacgccacgaccccgacccaccctgcccatcgtctcttgtccatgttctgaatccctgatataccggcccgcccggctcgcgcagccaatgtacgcgtcgggcgggaaccaaggtgatacggcgctgcgagagtcgtaacgcggcgtaacgaaatggtattgaccgttcggccgaatcgcgaaaatgcgctggaacgtctatagtgggttacggttcgacacaatcacgactgcgcgtttcccgattgaacagggtagaatcccgccaaacaccttgtggacgaacacgccacacacacgcacaacatattctctgacgcaggctcctgccgcacctcaatggccaatcccgcagaatcccatccgcaaaacgacttcatcaattcggcgcgcaaggaacgtaagcgtgttgaaatctatctcgtcaacggcattcgtctgacggggtgtatcgagtcgttcgaccagtacctggtgatgctgcgcaccccgtgggtctgcaaggcatctacaagcgcgcgatttccacgatccagctcgacacgggcggctcgcgcccgggcggcagcggcggccccgcgggccgcgcaccggcgggcgcccgggcggccgtgaaggcggcggtcacagcccgtacggctcgcacggcggcccgcgcgaatcgcgcggcgacggcggtggctacggctcccgcgaaccgcgtgaaggctatggctcgcgcgaaccgcgcgagggttacggctcgcgtgagccgcgtgagggctacggcgccccgcgcgaaccccgtgagccgcgcgaaagctacggcgcaccgcgcgatgccggcgacgcatccggcaacgcttcgccgtcggattcccgcggcggcaacgggccggtgatcgtgacgcgccgccggcgaatcgtgccggacggccagtaaaacaaagggcaagccaaccggcttgccctttactgtgcggccggcgcggcatgtcgccgcaccgctgccgggttcagcgtgccgtcgtcggcaaaccggcgtcggcctcccgctgcaacgaacgcacctgctgctgcaacgcccgcagttgcgactgaagctcggcctgctgcgcctgcaatgcggccgtctcgttacgtacgctcttctgacgatccgcgactgccgcctgctgctggcgtgcgatcgagatatccgcctgcagacgccgcgcgcgatcctgcgtgacttcgatctgcttgtccatctgcgccttctgcgattccagcttcgctgcccgcagttcgtttacggccagccgctccgcctggtgcgagaaatcgcggtagatcgcttccgcacgcgattcgtcgtaagtcttgatcacgcgccagaacgccttctgctggaacagcgcgacgaaatacgcgccgtcctttacgttgaacagcaggctcgcaccgtagctgccgttgtagctcgtgcgcatttccgtcagcgagtgcgcctggatctggcgctgcaggtcgtcaaccgtgctcggccccgtcgactcacctgcctgcggctgcaccgatgtctggacctgcggatcgaccaccggaatcgcggccaccggcgccgacgcctgctgtactgccggcgacccgctgtccgccaggctctgcgcataagcgccctgcatgcctcccaccacggcgagcaacacgcacgcctttcccaaccccgtcatatggctcatgaagttctattcccgcccgtgtcgttgtaattcagcgcgattttatctcattaattactcactttcgcgggtctcgggctcctcgtcaaagatctgatatttgcgcatttttcccacaataccttgcggctgataccgagctgctgcgccgtatcctgacgccgccagccgttggcgtcgagcgccgcaatcacgcggttgcgctcgttcatgtcccacttgctgcgatcgacgaagacttcggccgcgctttccgccggtaccggctgcgccgaactgcgcgcatgcgcgatcaaccgctgcaaccgcgcggcatcccacccgcccgtctgccgcaccgtcacaccgacgcgctcggcgaggttgcgcagttcgcgcacgttgccggggaaatagctgtccgcgacagagtccgtcagccagtacggcagatcggacaactgggcgagccgtgcctcgccgacgacctgtgcgacgaacgacttgaacagcgcgatcttgtcgacggcgccgcgctcttccagcgacggaatgctcagctcgatcaccgcgagccggtagtagagatcggcgcggaacaggccatccttcacgagttgcggcagcttcttgttgctcgccgcgaccaggcggaaatcgaccttgaccggcgacgttgcgccgacgcgcagcaccgcgccgtcctcgagcacgcgcagcagcttgacctgctggtacagcggcagatcaccgacttcgtcgaggaacagcgtgccgccgcccgcctgttcgaaatagcctttatgcgcaacaaccgcgcccgtgaacgatcctttcgcatgcccgaagaacagcgattcgaacaggccgtcgggaatcgcaccgcagttcaccggcacgaattcgccgtgccggtagcgcgaatgcttctcgtgcagcagttgcgcgatgcgctccttgccgacgccggtttctccgtgcagcagcacgttggtgtcacagtcggcgaatgtatcgacttcgtgcaggagtgcctgcatcgattccgagtgcgcgacgagctcggtcggatgcgacgtttcggccgtatgcgcccgcagctgcgtgacgagcttgccgatcatgccgcgcagctcggcgcacgtgaaatcgagcggcaggatgtgcgaatactcgggcggatactgcgaagcgtcgtgatcgcgcgcggcgccgacccagacgaccggcatgccgatgttggcctgccagtcgcgcaggaacgctgcgccgatttcgatcatcgtcacgctgatgatcgccagtgacggccgcaatgcggcgcgctcgggcgagatctccgcgttgtcggcgcggatcacttcgacgtcgaagctcgccatgcaccgggcgacgcggtcgacaatgtccgccttgccttcccagacgtacaggtcgagctcttcgattgcgggcgtggttctcatcggatggtcttgcttctctaattgctgactgtttgcgcgacgccgcaggtcagcgacatctgatgcaccgtggcggcgccaagctggacgccgagcaggtccagcagcggatcgatgataccgtcgagcgcggtcaacagcgggctcagaacggtggtcaggaccgacaacagcgacgaaatgaaatccggcgtgatcgtgaccgagatgagcccgaacagcagactcacggtcggcgtgatctgcgcgtttttcaggcccgccagcgcattgttcaccgccgaacccagcgcattcgtgttggtcgtccagtagtacgacggatcgctgccgccgcgtccgtagaacgtattggttgccggattaccggccagatccaccgacacgttggaaacggtcgcggacacctcgactgcaccagccaaaaccaggacgtcaagcaccttggctggcgacgtgcagctatagtttgccggcaggttcagcagattgccggacgtgagcggcggctggccgatgcagagattggcaacgctcggttgcgcggaaatcgtcgcggaattcggggacgtcaggcagttggtcgacaacaacgtcgcgcttccggcgcccagttgcacgtagagcggcagatagacgttcgcggaaaccacgaccggcagcgggttcacgcccaggttgacgacgagatacaggccgacctgcgcattcgtcgcgaccgtccgccacgcaccgtttttatccttcccgccttcgccgaccgcgatggtcggtgggctgatgacctgcgcctgcagttggacgatcgataccgagctgccgttcggcaacgtcagcggcacattggcgccgatcaccacgccgggcttgccggcctgcgagatctgggccatcgccatcacgagatcgagcacgttaacagtcgcgtctgccgccgcctgcgtgttcgcgagccccagcgtcaacagcgacgtggcgccctgtccggtcaggctcgcgaccttgatcgccgtgttgctgagcaggttcaggccgagcaggttggtcagtgcaccggttgcgcttgtctgcagcgtcgtacccagcgtggtcgacttgttgacggccgccaccatcgcgttgagcaaggtgccgaccgacgcgttggcattgacgagcccgccgatcgtcccgttgccgaccgacagcgactgcagcgcgacggcgatgtcgccgagcttgacgttcgcacaggcgagcccctggtacgacacgagattgaggttcagcggcgtgccgctctgcccctgcagcaacgagcccagcaacgcgttcaccaggccggggttcccgcttggcacgcccgagcagccgacgccgcccaccgcggccagcgtcgcgccgatagaaaaggtatcgatgttggtcgccttcgcagtcgacgttgcagtcaccgtacgtgtcggcccgaagaagaaatacggcagcgtcttggagaccgtcacgcgcaccgcgttcaactgcgtcgcgagcggcaccgtcgatttcgacgaatagaaggaactcgccgttccggtcgccgacggtgcccagtaaccgcattcggccgacagcgacgtggtgccgctgccgtcaatcgtgaagccgtttgtcgacgcgttgctcgtggccgcggaggtcacgttcgcacatgtatcgtcgagcttctgaaccgcagcgagtgcagcaagatcggccacgcgctgcatgtcacggcgcgtgaaaagacgttgccgatgtcgatcgaaccgagaatcaccatcgacagcagtatccacacggccgccgtgacgacgaccgaaccccgctgccgccgcggcgacgcgcgacctggtccggccatccgactcgatgcatgtcgagcagtgctcatcgctgctccgctcaatacgattgcgatgaactctgtccgccggacgatccgttgccgttcgtattgaccggcgaccccatcgattccggaatcttgtgcttgaacgattcgagatagcgttgataggaaagcgatgcggcatcgcccagtaccggcaaggccgggccggccgcgcgcccgtcacgctggaatgcaagcagcgcgttggttgcatgaccgatttccgacgcgtcgggcgccggctgatcgctatacgccgcagttgcggccccatgagcacgagaagcgcgacaccttggcacacgcgtgccacgcgacctggattcttgttgttcgtcatgtcagttccctatgcccttttcattgtgcaaaccgctgcagcaaaggcgcagtcggatcgaatccctggatgttcgcaaccggcgacggacgcttcgcgacattcgagcccgacacgtcgaccacgcttcccgaaccggtcggcgtcaaaacggaagccgaagccggtgactgggacgcacgacgccaggtacgtgccgccgtggcaatcttcgtcgcgtcgttgcggatatcgttgcgaacgtccatcgacagcttctgctgcgccatcagcttctgcgcatcgtgggttcggcccgaggcgagcaggtacagcaccaggttgctgatgatcttcggattgctctggtcgagctcggccgccttcatcagcggaatgcgcgcccctcgatatcgccgcaacgcagcttcgcgtaagcgagatccgaaagcgtcgatgcatcggtcggcgccagcacggttgcctgcgacaacgcctgcgcggcgcgcggaaaatcgcccgcgccgccggcaatcagcccgagcccgcgatagccgcgcgcggcgagcgttgtgttgagcaactgcgtatagaccgcagtgctcgcggcaggctggtccgtcatgcgcaatgcatcggcgcgcagcaggatcgtttgcggcgacgcaccgtactgtttctcgtatgcgtcgatatgcgccagcgacgcgtaatacagcccttgagcctgcatccgctcgatcaggccgagatacatgcccggcgtatccggcgccgcctgcttctgcgccgccgcgtccatcagcgccgcgcgttccgcctgcgggccgacgccgtacccgctttccttgaatgccgagcacgcgccgagcaagcccaccattgccaacacgcccagcactttcacaatttcatcgatgcgtctcatcttgcttcctttgcatcccggcatcagggctgcgcctggctcagcgcgcgcaacacggagatcattcccggtccggccgtcacgatcagcagtgccggcagcaacgtcaggatcatcacgcccgtcatctttaccgtcagcttgccgatccgttcgcgcagcatcgcacggcgcgcctcgcgcaaccggtcgccgaactgcttgagcggctcctgtaccgcgccgccgtgcttgtcgacctggatcagcagccgcacgatcgcacgcagatcctcgttctcgaaaccggacgacagccgctgcagcgattgctcgcgcgtccggccggcagcgaactgccgctgggcgatttccatttccagcgacagcacgggcatcatccccttgaagtcgttcgtcaggacctggatgctctggtcaagcgacaatccgacgccttgcagcaagcgaagcatgtcgaccagcagcggcagttcgtcgatcaccgcctgccggcgctgtgcagcacgacgtcgcaggtacagcttcggcaacatgaagccggtgacgagcgcaatgcctccacccgcccgccattgcgcaccggtcagttgagagcccatcagcatgaggaaaagcaacggcacgacaatcgcacaggcgagtcgcgcgctcaggaacagtccgcgggtgcgcgtgtcggcgtagccgcactgctccagcagcagccgatcttcgtcggcgacaagataccggcccaggcgggtatcgagcaggcgcgccccgaccatcgacagacggtccagccattgcacaagatacgatcgcctgtcacccgcattccgtcctaacggattctgccgggattcatcggactcctgtgcagcgcgcgtacccgctgcctccaacgtcgctgagcgccgctcgagcgcgctggccagcgtgcgatcgctgcgcgtctgcgcacttgcgcggcgtactgcaagcagcgccagcagcacgacgccgagtgcgccgagtgccagcgcgagcgaaccgagttgattggctgtcatgccgtcacctgagcttggccatgtggtacaaccagatcccgcccgcgaactgcagcatgaaggcgatgaacaacagctgacgtcccgtgtaatcgttccacatcgactggagatagagcggattcgtcgcgatcacaaagctgccgatcgcgatcggcaacatgaccagcacccatgcggacagtcgcgtttccgacgacatcgcagccagttcccgttcggcctgctcgaggtcgcgcatgaacgtcgacatccgatcgagcatgacgtcggcgcggccgccgtaccggaccgagagccgcagcaccgaaccgaccagttcgaattccttggtttgatagacgctcgcgatgtgtcccatcgcacgatcgatctcgacacccgtgcgcaacatccgcgatacgtggtccagacaaccgcgcaacggcgcctccgtcgtcagcagtgccgcctggaacgccgccggcacgctgttgccgagcgtgacgagacgcacgatgccgtcgagaaacgacggcaactggcgaacgatcgtcaggcgacgccgctgaatgcgggacacgagccagaacacgagcagcgacgcgccgcacacgagcgcggcgacgcaagccagccagccgccccgattaccggcgacgagcccgagcgcgaccaaccccagcagcgcgagaagcgccttgccgcgcgcatcctcgatgcctgcacggctcgccacgttgacgaggtattccgtaccgatctcacgccactgcgcccagcgcgaagccggcgcagcggactgcgcgcgggccgcaccgggcacagacgcgacattctggaccggtctcgcgtcaggctgaagcgcacccgccgctcgcgcggccggctcgatgcggctgtcgatgaagcgctgcacgtcggcgcggccgcgtttcacctcgccatgccgccacagcatcaacgcggcggcaacgcaaaggagtgccattgcaagcgcgccagccatcaggctatacattgaaacccccgccgccgcggccgaatccgccaccgaatccgccgccaccgctaccgccaaagcccgcggcctgcaacgactgacggaaacgcgcgagcttcggcgaatgcggatgaatgccgagcgactcccagttgtcgacctcttcgccctcgggtgtcacgcgcgcttcgtagcgatagagttcctgcgtcgcgatgatgttgtccgacaggccggtcacttcggtaatcgaaagaatccggcgtcgaccgttcgacagacggccgatctgcacgatgaagtcgatggcattcgcgatctgccgacgcaggctcgattccgttccctggaaacctgcgaaaccggccagcatctcaagacgatacagacactcgcgcggcgaactcgcgtggacggtgcccatcgatccgtcgtgccccgtattcatcgcctgcagcatctcgagcacctcgccgccgcgtacttcgccgacgatgatgcgatccggccgcatccgcagcgtattgcgcagcaggtcgcggatcgtcacgacgccgttaccgtcgaaaccgcccgggcggctttcgagacgcacgacatgagggtgattcagcgacagttctgccgtgtcctcgatcgtcacgacccgctcgtgctcgggaatgtagaacgccagcgcattgagcagcgacgtcttgccggaactcgtgccacccgacacgaggatgttgcagcgcgcctcgaccgccgcttccagcaacgtaccgatctccgtattgaacgtgccgttggcgagcaggtcggcaggtttcagcggatccttgcggaatttccggatcgatacgaccggcccgtcgatcgacagcggctcgatcacgacgttgacgcgtccgccgtccggcagccgcgcgtcgaccatcgggttcgattcgtcgagacgtcggccgatcggcgcgaggatgcggcgcacgatccgcagcaggtgcgcgttgtcggtgaaacggatcggcagcttcgccaggatgccgtggcgcgacacgtagatgtcgttgtagccgttgatcaggatgtcctcgacgtgcggatcggcgagcagatcctcgatcggaccgaacccggcgagctctttcgtcagcgcctccgcgatcgccctgacctcggtctcgttcagcggaatgcgccgtagacgcacgaagctgtcgatttccagatcgacgaactggttgatcgcctggcgcgaccagcggccgaattcggcgccgagttcctcgatgcgcgtcaacagatgctcgtgcgcggcattcttgatgtcgtgaaactgctgcgactgggagaacggcgctgcgccgtcggcaaattggatgtcgtgtgccatcgcttacgatcgcctggacgaaggttgaatgaaacgcttgagggcggacaggcccaatgcaccgcgctggccggcggagatcgggccggccagtcgatctgcgagcggctcgagagcacgcacatacggatcgcgttcggccgtttcgacgatcagccgccctgattggccgcctggccgatggccacgcgacgcgccggcagcgtcgccagcagcgaaatgccgagccgctctgcgatctgggccggtgtcaggctcagcgtcgcgtcgtactggttgacgacgagacgaatcttgccgatgtcgacgccagcatcgcgcagcccttccagcaggtccaccgcagagacgatcgatgcgacgccctggtcgcacacgagccacgcttcgtcggccacggcagtgatctgcgcaacgaattcatgattcgtgaatccgccgagatcgacgatctgctggtcgaagaacgcgcgcaaccggttcaacaggccgacgcaagccgcatacgacacgtcgcgcaggtcggcgagattgggcggcaaggtggtcagcgcgacgccgctcgcgtgacgcgtcagcgccgtgttgacgaaggtccggtcgatgcgccgcaggttgcgcacggcttcgacgaaatggaattcgcagcgcgtgttgaggaacagcgcactgtctcccgcgggaagcccgaggtcgaccagcgccgtctgccgcgcgtgaggcgcggcgactccgaacgcaggcgtgcccgcttccggggtgcccgaacccgtacgcttgtgcagccacaccgacagattcgcggcgagcgtgctgacgcccatccccgcgcgagcgccgagcaacgcgacgagtttgccgtgccggttggccggttcggtaccggtatgctcgagcaacccgcgggtgatccgcaaagcgtcctcggcactaccggacacgtcgatgaaatcgcgtacgccagcccgcagtgccgcaagcgcgctttccggctccgaaagcgtgccgagcgcgacgaccggcaggcccggatgggcgagccgcacggccgccgcagcagcgctcgccgcgccctgcgtacgggaaaatcgatgaatacgatcgcaggattgagccccgtgatgcgctggctcagcgcacccggttcaagcgacaacgcttccaccgtgccggccgacaccagtgtctcgcccagccagcgggcatgctcatcctgctgcgatgcgcacacgaaataatcggtcacggcaggctcagccaacgatagggttctcgcgttcatgttgaacacccccggttacatatcgcgcgacatctcgtcccgcattcatttcgaaaatccgggcgctgcatcgggtgatgcgataccgccaagatacgaccgccacaccggcccatcacgctgttcggacagttcgcccggcgtagtcggcaacggcgcgcccttcgcgatcggcgcaacgagatgcggcgtcacgatgatcaccagctccttgtcgttctgctgataattcagcgacttgaagaaggcgccgatgatcggcagatcgcccaggaccggcaccttgttgatgttcgacatcgtttcgcggtcgatcaggccgccaatcacgaagctttccccgtcacccagctcgaccgtcgtatcggcgcgacgggtcgtgatcgccggcaccgatacgctgttgatcgtgacgccatgctggaagtcgagctggctcgattccggcgccaccttgagcgcgatgcggcgctggctcagcacggtcggtgtcagggtgaggccgacgccgtactgcttccagtcgattgccgtggagccaagcgcctgcggcaccggcacgggatctcgccgccggcgaggaagctcgcgctttgcccggacaacgccaccagggtcggctgcgcaagtacccgggcaaggttgttcgcctcgagaatcgaaatattgccgaagatgccgcggcccgccgaattcaccaccagattgaacgcggacgcgatcggaatgccggcagtcgcctggaacgccgccgttccgccaccagtcaccgactggagaccgcccggcgcaaatgcgccgaatgcgaatccgttgctttgcttgaagaaattcagcccggcttccttcagcaccgagcggctgaattcgacgacccgcacgtcgacttgcacaacgctccggttaccgactgtcgacgtatcgatcacggtcgcatctttgccgcccatccgcttgccgactgcaactgcccgctcatgcgcgtcgagcgaagccgccgagcccgacacgacagcggcaccgccgtacgccttcacggacggtcccgcgccgtccagcacggcctgcgcggccgcatcgacgacattgacattccacaccgtcggctcgtcgcgcccccgctcccacagcatcacgttcgtcgaaccgggagccttcgcaaccagcagtacgttgccggcgcgactgcccttcatgaccagcacgtcgacgaccgaaggatcgcccaccgcgatccgctgcaacgtacggccggtagcgacctgccgctgcgagccgaccgcaagatcaatcgacccgtttgcgccggcagcctcggccaacacggcgaaggtcatggcccagatggcaatcgcgtatgcaatcagtttttgtcattgtttcggagaccgtcgtacggccttctcccttccgttactgctgtcgatgaccgtgcttggattgtcaataagcgaccgtttcggtccgcccaccccggatcacttcaatgctgcttccgccttcgcgcgcgacgatcggcgcacgcggggcacgcggcggcgcctgcacgcggggtgcggtgcgcgcacgcccacccgacagttcatcgagccatacgccggcggccgcctgcccggaaggcgtcagatcgccggccgtgcggatcgcaaccgtctgtgtcgcgacctcgtcgtcgcgcggattgcggagcgcgagcgtcaggcggccgctcgcttccgcgagcgtcagtgcatcaacctgtgccgtcggcaccgcgagcacggcggtccgtaccgcaccacccgggccaccgctaccgtcgcggtcgggcgtcgcgtcgccgaacgacaggatccgcagcttcgacatcagcagtcgcgcctgtgaattgggaatttccgatccggcttgcgccatccccgagttgtcgcgtcgcaaattcaggaacacgtcgacaaagttgccggggcgcaaccggtttccgaccgcattcgtctcgtcgaccttgatggccacggcccgctcgccgggcgccacctggttcgccagccctgacgtcaagccgccctcgacgaccggcgcggcggcaaggatgtcgttcgccgggatgcgaccgaccagcagcgacggatcgctgaatccgccagtcggcatcatcggtgccgacgccaacttcagcgcatcaaccggaatcggttgaccggccggcaacagacgcgtcgccacgaccaccggcaccgtctggaccattgccgcggcaggcaccgcggccggcggatgggccggagcgcggccgagcatccacgcatagatcccgagcagcacggcgagcgcaatcagcagcccggcgatgatcttcgtcaagttgttgcccatggtgaatgttgagtgccgtaaatgttgttatgtcgacatgtgaacgccgcttgcgcctgttgccgcgcactggccggcgtccgtttcataaaatggtcgccggattgatctgcacggttgccgtgccggtcaactgcgtcggcgtaacgagcccgagcaagggcagcgacggaaccagcggattggtcttgtacggatacgtcaccgtgaccgtcacgcaatacatggtcgcgtcgtaactgcatgcccccgacacgggtgtcggaatctgaacgttggccagccacgacgtcagcccgatcgcggtcgactgtgccgccttcgcccggtcggtcagcgcctgcgcccccgacccgttggactcgtagacataattcagcgccgtgcgcgcaccttcggtcgcagcaagcgtcaagccttgctgaaccgcgaagatcagcccgaacgtcacgatcgcgtacatgatcaggaagaacagcggaaacaccagcgcgaactcgaccgccgtcgcccccttctgacgccgccatgaccgtggctggtactgtcgcttcattgcagcccccggtaacgacgagataggccaaccatatcgctgccggagcgacaagacaggctgcgtaaggtgttgcccgccgtgcgccgagcgagagcgtcggtgaaccgcgcgaccacagcgcgcccagcgacgtatgggtcagcgtcatcagtgcgaggacatgtataccggccgcaagactggcgacaacccacagccatggcagtatcgacaaaccgcaccacgcgccgagaaccgcaaacacctttacgtccgccgcgcccatgacgcgaaatgcaaaaagcgggaaaaagctcacgaaaccgacgagcatgccgatcaatgcctgctcgactgaaacacgaaacggatttgcatcaaccaatgcgctgccaagcgccgccaaaagcccgacgacgacaagcggattccgaacaagccgaaatcgaatatcaccgacggcaacgagcgtcgcccaggcaaaaaatgctggtgctgagaagatgtgccatatcgcgatcgaccgaccaagtcgacgtaagggcgagcggtccgcaaaacggaccgctcgccgcccaccggactaccgaggatcagccgcccggcaacgaactggcaatcgtggagaacagcgtcgagatcttggtgccgatagtggtgacactaccgatgatcaaggccgcaatcagacccgcaatcagaccatactcgatcgcggtaaccccgtcttcttccttaaggaagcgcttgatgagtgctttcattttattcctcgtgcctgtatttacgttctttggccttttatacgcatacatccccgcatatccggccggttgccccgcgctgttcgccacatctgctgtaacgacaaccaggtgcactttctttatagattgccccgaggggcatggctcaccatttgatgcaagttaacattcgcgatagcaaccctcctcgaacgttgtgtaccgaaccgtacatttccttacatctgctccggattctatatccgatcctatttaagttccaacctcttttaacgacttggatcgaaaaaatgaccgtgagcacagcgtatttgtacggcgtttcggtacgacttacacataggatttacgataggttagatgtgcacacctaatccacctgtaaaacagttgcctcgtccaccaagcctgcgcggcctcccacgttacgtcgcacgcgtaacgccaatgttgtgacgttacgttacgaaacgatcgaaatcgttctcattcgtctgcacttaaacagattcaacaatctttcaattcccgtaacttccttttccgacaaggaattgccccgtttaaaacctgttgccgaaccgtcgggcatcgaaatggcacgacagttgcagagtagtcctcgcaccactcaacacaacgcagttcacaacacattttaatgcgaggacaaaatggacattaaggttatccctcatggcgtgttccggacgactctgatcgcggccaccgttgcagccatgctttccctctccgcgtgcggcggctcgggttccatcagccagggtcttggcggcggctcgagctcgggcggcggcgatacgatctccacgtccggcacgagcggcacatcgggcacgtcgggcacgagcggaacttcgggtacgagcggcaccagcggcacctcgggtacgagcggtacgtccggcacaagcgggacctccggtaccagcggtacgtcgggcacgagcggcacgtccggcacgtcgggcgtgtcgtcgaacccagtgggaactgtcctcgcaagcagcagcaacatcttgacgggtgtcggcggaaccgtctcgggcctcggttccgtcatcggcagccagacgctgccgggcgtcaacccggccaccacacaagccgcgggcggcatcgtgcaaagcgtcggcggcgcagtgaccgcactcggcaacggcctcggcaacggtctcggccagctcggcgcgacgaaggatccggtcggcaccacgctcgccagcacgggtggcgtggtcaaccagctcggcagcgcagtcacgcaaacggggaccctggtctcgagcctcggcagcggcccgctctcgccgctcgcaccggtcacgggcgccgtcggcggcctcgtgtcgacgctcggcggtgccgtctcgaacggcggcaacaccctcaccaacgcactgtcgaccggcccgatccagcaggtcacgcagacggtcagctcggccatcacaccgatcacgacgatggtcggccagacgacccagacgatcggcacggcaaccggcctcggcgcgcccgtcaacacgctgctcggcacggtcggcaacggcctgaaccaggccggcgccctgctcgcgtcgacgggcggcaatcccgtcacgaccggtcttggcaacacggtctcgtcgacgggcaacaccgtgaaggccgtcggcggcctgctcacgggcggcaccggcggcataaccaacccgctcgcgccgctcaccggcctcgtctcgacggtcaccggcgcactcggcggcgcaacgggtggcggcagcggcccgcttgccccggtcaccggcctcgtttcgacagtgaccggcgcactcggcggcgcaacgggcggcggcagcggcccgctcgccccggtcaccggcctcgtctcgacggtcaccggcgcgctcggcggcgcagcaggcggcagcggcggtccgctcgccccggtcaccggcctcgtctcgacggtcaccggcgcgctcggcggcgcagcaggcggcagcggcggcccgctcgccccggtcaccggtctcgtctcgacggtcacgggcgcactcggcggcgcagcaggcggcagcggcggcccgctcgccccggtcacgggtctgctcggtaccgtgacgggcgccctcggcagcgcaacaggcggcgccggcggcagcagcccgctcgccccggtgacgaacgtcgcgtccacggtaacgagcgcggtcggtgccccggcattgaccggcggcacgggcgccgtcacgaactcgggctcggcgtcgaatccgctcgcaccggtcacgtcgctgatcggcggcctgctcggtggcacgcacggcaagtaaaccaacatccatcaatcgacaagacagcgaggagtcaatcatgtcccagcaacgttctctcacgacagccgccctgcaccagtggcgcgtgcccctcacggccttcgccgcagcctgcctgctggccgcctgcggcggcggcggcgtgagttcgccgccgaccagcagcaacaacaaccccagcagcacgagcggtacaccgagcacgagcggcaccagcggcacgtccaccggcaccaagggcgtcgtcagcacggttggccagacggccaccgacctcggcagcacggtcggcaacatcaccgtgcccggcctcggcgacggtgtaacgaagggcgtcggcagcacgctctccagcacgggcacgatcgtcggcgcagccgccgatgccgtgagcaacgggctgggacagatcggtacgactaaggatccggtcggcacgaccgtcgcaggcctcggcaacgtggtcggcgcgacgagcaacacggtgtccggcctgagctcgacggtcaaggcgctcggcacggggcaactcgcgccgctcgcgcccgtcacgaccccggtcggcaccgtgctcgacacggtggccaatggcctgacggctgccggcacgacgatcggctcgacgctgtcgtcgggcgccgtgcagcaagtgacgcagccgctcagctcggcgatcacgccgctcgtgatcaccgcgggccagatcacgcaacaggtcggcacgacgaccggcctcggccaacccgtctcgggcctgctcggccaggtcggcggcgcgatcagttcggccggcaagcaggttggcggcacatcgagccagccgctcgtcggcgacgtcggtcagctcgtgacggcggtcggcaacaccgtgaccaacgcgggcggcctcgtcaacccgaacggcccgaacggcgcggcgccgatccccggcctgatcacgagcctcgtcggcggctcgacggcgaccgtgcagaacggcacgtcgtcgggttccggctcgacgaatccgctcggcggcctgctgtcgggtctcggctcgacgccgctcggctcgctcacgggtgcactcggtggcgcgaccggcggttcgggcagcagcccgctcgcgcccgtcacgggcctcgtctccaccgttaccggcgcactgagtggtgcggcgggcggtagcggcggcccgctcgccccggtcacgaatctcgtgtcgacggtcacgggcacgctcggcggcgcagcgggtggcgcaggcagtgcaaaccctctcgcgcctgtcaccggtttgctgaatactgtcaccggagcagttggcggcgcagcgggctccggggagcgagcccgctcgcgccggtcacgtcgctggtcggcagcgtcacgggaacggcaacgtcgggcggcggctcgacgggcctgctggcaccggtaacggggttgctgggtacgctgggtagcgttggcaagtaaggaggacggtcgcaccttcgcagccggagcggatggtacgaccgtacaaacacaaccggcattgcggcacgcggcgcgcggcaccctggtgtcgcgcgccggcattacaaagaagacgaaaagcaaggcctacgaggaagaacaatgaaatccagactcgacagatggatgatgctgctcgccgccatcgcggcagccagcacggcacaggcacaaacgcgcgtcggcggtaacccgctcgactccctgccccagatcaacgcgccgaaaaccggcccgaacgtaaccgtgcaggtcgcgccccaggcgccgcaactgcaggagttgctgtcgcgccacctgacaccgacgacattccaggtcgaaggcgtaaagtcggtaccgttcgaggaaatctcgcgtcgcttcaccccctcgtcggcaaggacatcacgatcagcgatctgatcgaaaccgccaacggcgtgacgaagctttaccaggaacgcggttacgcgctgtcgttcgcgtttgttcccgcgcagacgttcgagaacggtgtcgtgcgcatcacggttgttgaaggctatgtgtcggacgtcaaggtcaccggcaagcccggggcaatggaatcgaagattcgcgcgatcgcagcgcatatcaccgacgatcgcccgctgcgccgcgcaacgttcgagcgctacgtgaacacgttcggcctcttgcccggcctcacggtgaaggcgaacgtaccaccaccgcaaaccaccgacggcgccacgacgctcgaacttgccgtcgaccgcaaggcattcaacgtcagcaccggtatcgatttcaaccacccgggcgtacagggcctcatcaccgcgaccgaaaacggcctcacgaagttcggcgagcagctgagcatctccgcactggcgccgccgggcgtgacaagcagacctacttcgcgttcagcggcgcggtgcctgtcggcagcagcggcctgatcacgcgcctcgacgcaagcacctatcgcggcaagcctactgacaatccgggcctgccgtcgtccgtcgaacgcactgtcaagaacgagaagcttggtctttcggcatcctatccgatactgctgaacaaccagcgcagcctgctcggcactgtgtcgggttatgccgcacacaacgaagaccgctaccaaagccagaccaacggcaataccctcgaaaaccggtcacaggtccgcgtgatgcaattgcagctcgactacacgagcgtcgaaccgaagcaggtgcgaaaactgagcgtcaacgtcgccaaggcattcgacatcctcggtgcatcgaaatcgcagactggcgtggttaacggtgtggggtttacatacgccgacccgacgtcgctgaccttcgtccgtaccggcgcgaccttcacgcaaaccaacgaatggccgttccggatcggcacgtcagtctcgctgaccgggcaatacagccctgactcactgccgacgtccgagcagatctcgttcggctcgacgcgctacgcgctcggctatcagccgggcgaagcgtcgggcgactcgggatggggatgtcgctggaggtcaaccgtggcttcacgccgggctggacgtatatgaagtccgtgacgccgtacatcgcctacgacatggcgcgtgtgtacctgcattcaggcacgccgtcgcccaaccgtatgtcgtcggtcggcatcggtgtgcgtttcacggacagccgcttctacagcctcgacctgaacgtcgcgaagccggtgggtgacgcgccagtcgaaagcgcatcacgcagcccgcgcatcaacgccgcattctcatatcagctcaactgatcggtcaccaaacagcccgcgccacgcgggctgtttcgattagagtcccctctatcaaacgtggcgcgcggtttcacgtattctggcgaagctcgcaacatgcccgccccatgcagacggtcgtgcgggcaaatcgaacacgacatgcaaaacaaggaggatgacaatgattcaactgacccgcccgttgcgtgcaatcgccatcaccggcgcactgctggcttgcgccaccccacgttcgcacaggcagacagccccatcggcatgtggcagacgatcgacgacaacacccatcagccgaaggcactcgtgcagatcgccgaggacggcgacggtgcgctgaccggcaaggtcgtcaagggcctcggcgcgaacgatacgcctgatcgccgctgcaccgcctgcacggacgagcgcaaggatcagctcatcaagggcatgacgatcatcaaggcgatgaagaaggaaggcgaccactgggacggcggcaacattctcgacccggagaacggcaaggtctacaagtgcaagatgacgcttgaagacggcggccagaagctcgtcgtgcgcggctatatcggcgtatcgctgctcggccggtcgcagacctgggttcgccaacaataacgcggcgcgcgctgaaacgcgcggctcaacgaaaaaccggcctgacgatgaattcgtcaggccggttttctttggtgcgcgcgtcggcgcaaacaacgcagtaaacagcggacatcaggctgcatgcttcatcgcatccggcgcataaccgcctggtgtgcgacccacgggtaccacgccgctacgcgcctccgccgccttcgattgcgtatgcttgcgcatccgcaccgacaattcgttgcacaggttcacgcccgagtcgccgtagagttcacgcatcacgctcatcagcgtgcccgtctcatgccagaccttgaagcggcgatggcacgtctgatacgaagggtaacggcgcggcatcgccgaccacgttgcgccgctgtatatgacccagagcacgccgttcatcacggcacgggtattggctagcggccggccgcgcaactcggtgcgcggctgcatttcgggcagaagcggcgcgacgcggcgccactcgtggtcggtcagatcgcgatacggtgtcatggacatctccagccttggtaaccatgacacaacgatatcggctcacctcaaccgtgaatataagacaagtccgaaaataccccgagatcgcctgaatttgaccggaattgacgtttgaataccgccaattgccggaaatcgcactcaggtcagcgacgtatcgacgatgcggcgcggtgtttcgagatactccttcgactgcatctcgacgatgcgcgagaccgtacgcgcaaactcgttggccatcggaccttcgacgtacaactgctccgccggaaccgccgcggacatcagcagcttgaccttgtggtcgtacagcacgtcgatcagccacgtgaagcggcgcgcttcggacgccatccgcggcgacatctgcggcacctcggacagcacgatcgcgtggaaccggctcgcgagttcgagatagtcgttctgcgagcgcgggccgccgcacagcgtcgcgaaatcgaaccacacgacgccgtccgccttgcgcagcgccttcagctcgcgcttctcgatatgcaggagcgggctttcatcgggtaccgccgcgagcttgccgaacgcatggcgcagttcgcgatcggcgtccgcgccgagcggcgtgtgatacatcttcacctgcgcgagcgtgcgctggcgataatcgacgcccgcgtcgacgttcagcacgtcgagcttgtccttgatcagcgcaatcgccggcagcatgcggtcgcgatgaagaccgtccggatacaggtcgtcgggatcgtagttggacgtcatcacgaactgcacgccgttgttgaacagacggtcgagcagacggtacaggatcatcgcatcggcaatgtccgacacgtggaactcgtcgaagcagatcagacggtagcgcttcgcgatacgccgcgcgagttcgtcgagcggatcggcctgccctttcagttcctcgagctcgcggtgtacctcgcgcatgaattcgtggaaatgcaggcgcgtcttgcgctgcacgggcacgaccgcgtagaagctgtccatcaggaagctcttgccgcgaccgacgccgccccacatgtagacgccgcgcgggaggtcgggatgattgatgagcttcttgaatgcgttcgagcggcgtgccttgtactcgacccactcgtcgaaacattgctgcaggcgatcgacggccgcgcgctgcgcgggatcggactgatagccgcgcgtggtcagctcgcgcgtgtagtattcggtgacgttcatcgggcaaaccggaaaaacgaaggcggacgggaaaccccgcccgccctcgtcatgagacggctgcgccggccgatggccggccggcgctataccgcgctcagctgttcagcgagcgcttgtcgacggcgagcgccgcttcgcgcatcacttccgacatcgacgggtgcggatggcagatacgggcgatgtcttccgacgccgccttgaattccatcgccaccacggcttccgcgatcaggtccgacgcgttcgcgccgatcacgtgcacgccgagcagttcgtcggtcttcgcatccgcgatcatcttcacgaaaccgtccggcgcgttcatgccgagcgcgcggccgttgatcgagaacgggaacttgcccgacttgatctcgcggccttccgccttcagctgctgctccgtcttgccgacccatgcgatttccgggtacgtgtagatcacccacggaatgcagttgtagtcgatgtgcggcttctggccgtcgatcacttccgcgaccagcacgccttcgtcttccgccttgtgcgcgagcatcgggccgcgcaccacgtcgccgatcgcgtagacgttcggcaccgccgtgcggcagtggtcgtccacgtcgatgaagccgcgctcgttcgccttcaggccgattgcctcgaggccgaggttgtcggtgttcggcacgcggccgaccgacacgatcaggcggtcggcgtcgagcgtctgcgcgttgccgtccttgtccgtgtaagcgatcgacacgccgtcagcggtcgtcttcacttcgccgatcttcacgccgagatggatgtcgaggccctgcttcttgaacagcttggccgcttccttcgcgagcgcttcgtcggctgcgccgagaaatgcgggcagcgcttcgagcaccgtcacttcggcacccaggcgacgccacaccgagccgagctcgaggccgatcacgcctgcgccgatcacggcgagcttcttcggcaccgagtcgaacgtcagcgcaccttcgttgtccgacacgatcttgttgtcgaccgggatgcccggcaggtgacgcgccttcgagcccgtcgcgatgatcacgttcttcgcggtgacgacttcggtttcaccctcgccgctcacttcgatctgcacgccggcgtcggtcttgccggtgaacttgccatggcccttcagccaggtgatcttgttcttcttgaacaggaactcgatcccgctcgtcatcttctcgacgatcgcgtccttgcggccgagcatcttcgcgatgtcgatcttcacgccgtcgaccgtgatgccgtggtcggtcaggtgatgcgacgcgttctcgaactcttccgacgacgcgagcagcgccttcgacgggatgcagccgacgttcaggcaggtgccgccgagcttcagcgcgccggccgggttcttccacttctcgatacaggcaacggtcttgccgagctgcgcggcacgaatcgcggcgatgtagccgccggggccggcgccgatcacgacgacgtcaaattccttggacatgacaatcctttctacttgtacgcctgcacgttcgcgcgcgggcgcgaacgtgcagaacgggtcgatgcagtgagactcggcttacaggtcgagcagcaggcgtgccggatcttccagcgcatccttcatcgcgacgagcgacagcacggcttcgcggccgtcgatgatgcggtggtcgtacgacagcgcgaggtagttgatcggacggatcacgatctggccgttttcaacgaccggacgctccttcgtcgcgtgcacaccgaggattgccgattgcggcgggttgatgatcggggtcgacagcatcgagccgaacacgccgccgttcgagatcgagaacgtaccgcccgtcatttcctcgatcgacagcttgccgtccttggccttctggccgaattcggcgatcttcttctcgatctcggcgaggctcagctgatccgcgttgcgcaggatcggcacgacgaggccacgcggcgagccgacggcgataccgatgtcgaagtagccgtggtagacgatgtcgttaccgtcgatcgacgcgttcacgagcgggaacttcttcagtgcgtggacagcagccttcacgaagaacgacatgaagccgagcttcacgccgtgttccttctcgaacttgtccttgtacttgttgcgcagctccatgaccggagccatgttgacttcgttgaacgtcgtcaggatcgcgttggtctgctgcgattcgagcagacgctcggcgatacgcgcacgcagacgcgacatcggcacgcgctgttccggacggtcgttgagccacgtcgtcgccgacgccggcaccttcacttccggcagcgacggcttcgccgcggcctttgccggtgcggcagccggagcggccttcggtgcgctgcctgcggccagcgcgtcgcccttcgtgacgcggccgtcgcggcccgaacctgcgacgtcgcctgccgacaggcccttctcggccagcagcttcgatgcggccggcgatgccgtagccgagctcgatgccgttgcggtagccggctgtgctgccggtgcggctgcagcaggcgctgcggccggcttgacttcggccgcgcccgccgcggcttcggctgcacctgccttcgcttccgtatcgatcgtagcgatcagttgatcggcaacgacggtgtcaccgtcgttctgcagcacttgcgcgagcacgcccgcggccggtgccggcacttcgagcacgaccttgtcggtctcgagttcgatcaggatttcgtcctgcgcgactgcttcgcccggcttcttcttccactgcagcatggtggcttccgaaaccgactccgaaagctggggactttgacttctacgatagccatgtgattttcctggatgcttaatctggggtgtgacgaggttcgtgcgattccttcggccggtgcggcgcgcagcgcggcgggccaaaggagacgggaaagcgcgctgcaccttcccgtttcgcttccgtcggttatttcgcgatcgatgcgctcttcaggcggccgaaagcaccttcgatgagggccttctgctgctcgtagtgcttcgcgtagtagccaaccgccggcgaggccgaagccggacggccgctgtatgccagcttctgcccttccttcatgccttccttcaggtggtgctcgacgtagaaccaggggccctggttctgcggctcgtcctgcacccagaccacttcagtcgcgttctcgtacttcttcatttcagcttcgaactgcttgtgcgcgaacggatacagctgctcgatacggatgatcgcgacgtcgttcgccttcgcttcgcggcgatgtgcgacgaggtcgtaatacacgcggcccgagcatgccagcacgcgcttgaccttcttcgcgtcgatgccgccgtcggtttcgcccagcaccggctggaacgaacccttcgcgagctccgacaggtccgacacggcttccttgtggcgcagcagcgacttcggcgttgcgacgatcagcggcttgcggaacaggcggatcatctggcgacgcagcaggtggaaaatctgcgccggcgtcgtcggttgaacgacctgcatgttgtgatcggcacacagctgcaggaaacgctcgatacgcgtcgacgagtgttccggaccctggccttcgtagccgtgcggcagcagcatcgtcagacccgacacgcgaccccacttcacttcgcccgacgagatgaactggtcgatcacgacctgcgcgccgttgacgaagtcgccgaactgcgcttcccacagcacgagcgtgttcggctcggcggtcgagtaaccgtattcgaagcccagcaccgcttcttccgacagcaccgagtcgatcaccgtgaacttcgcctgaccgtcggcgatgttctgcagcggcacgtacgtgccgtcgttccagcgctcgcgattctggtcgtgcagcaccgcgtgacggtgcgtgaacgtgccgcggcccgagtcctggcccgtcaggcgcaccgagtagcccgatgcgacgagcgacgcgaacgcgaggtgttcacccatgccccagtcgagcggctggtcgccacgcgccatgttgcggcggtcgttgatcacgcgctcgacgagcgggtgaaccttgaagttttccgggaccgtcgtgatgcgttcgcccaggcgcttcagttcggcgagcggcacggccgtgtcggctgcatccgtccacttgcggttcaggaacggaacccagtcgaccgcgtacttgctcttgtagttcgacaggaccggatcgaccgtgtggtgaccgtcgtccatcgccttgcggtacgccttcacgtagttgtcggcgtcttccgcggtgatcacgccctgctgcacgagcttctcggcgtacagcgcacgggtgcccgggtgctgtgcgatcttcttgtacatcagcggctgcgtgaccgccggcgtgtcctgctcgttgtgacccagcttgcggaagcagacgatgtcgatcacgacatccttgtggaactgcatccggtagtcgatcgcgatctgcgtcgcgaggatcacggcttccggatcgtcgccgttcacgtgcagcaccggcgcctcgatcatcttgacgacgtcggtacagtacagcgtcgagcgcgcgtcgcgcgggtcggacgtcgtgaagccgatctggttgttgatgacgatgtgcagcgtgccgtgcgtgccgtaaccgcgcgtctgcgcgaggttcagcgtttccatcacgacgccctggccagcgaaggccgcgtcgccgtggatctgcaccggcagcacctgcaggccgtcttcgtcgccgcgacggtccatccgcgccttcgcggaaccttcgaccaccgggttcacgatttcaaggtgcgacgggttgaacgcgagcgacaggtggaccgggccgccttccgtcgacacgtccgacgagaagcccttgtggtacttcacgtcacctgccggcaggtcgtcgacgtgcttgccttcgaattcggcgaacaggtcggccggcatcttgcccagcgtgttgaccagcacgttcagacggccacggtgcgccatgccgatgatgatttcctgcacgccgcgcttgcccgcgtgctggacgacttcgtccatcgccgcgatgaagctttcgccgccttcgagcgagaagcgcttctggccgacgtacttggtatgcaggtaacgctcgaggccttcggcggccgtcaggcgattcaggatgtgcttcttctcgtctgccgagaagttcggcgtcgcacgggtcgattccagacgctcctgccaccagcgcttctg
